United States Patent 11,866,728 (ENGINEERED RETRONS AND METHODS OF USE) - sequence listing, part 6

SEQ ID NO: 13884 - RNA, 1446 nt, unidentified
  source 1..1446: mol_type = other RNA; note = synthetic construct
atgaatctggtgaacctattggtgaccctgagggatgctctcgtggacttcgaggcgaatcgtcagaagatcttaaccctgctcaaaacgcatcagggattatccgaatttgaggtggcccggtatttcgtggcagccgaggctgctccccgtgtacacaagtatctggcctcacgggatccaagagagagaaggatcggagtcgaatgcgcccgctttcttctgccccctaacgatgccgcagctgttctgcgtcgcgcgttggtggaccccgataccagcacccgagatagggctgacagattacttgcccagctagaacggcaagaagctccgttacgggcccgcaggtctacacccgaagccgaactggttgacgcctggggaccgacagggtggagattcggtcgcctgctgaggaatcctcccgcacggaaaaaagcgaaactcgccccagttcctcgagctgtctcagccgtcctgaagagtgaggagacattcctgaaggctattgaggtggatagcgtgtcggccctgcaaccgctctatagagcaggggacgggccaggtgcaccttacgttcggttcgaaatcgcgaaacgaggcgggggcgtaagggcaatactcgcaccccggaaagccctgaagggcgtgcagagagccctgtatgaaaaggtcttgtctaagcttgcgactcacgatgctgcccacgggtttgtcccaggtcgatccgtggtgaccaacgcacgacctcatcagggggccgtaactattcttaaagtcgatctggccgactactttcccacactgcactacagacgagttcagggctattttgcgcgggtgctcaaggctaacgccaaggtggcaacgctcattgccggactaaccactcaccgcgatcgcctggctgacgggtacgtgacaaggccaggggtcatgccccaaggcgctcctacatctcccgcactggcgaaccttgttagccggcgcctcgacgagaggctagatggcttggctaagaaggtaggtttgcgctacactcggtacgccgacgaccttacgttctcctggcacgaagcacctccaacaaggcaggccctggcacgcgtgttatggtgggtcagtcaaatcgctagggaagagggcttcgctctcaacgaacggaagacccgcgtgctgcgtccacaccagcagcagttggtaactggcgtcgtggtgaatgccggccttcatgtgccaagggccctcaaaaggaccctgagagccatgctgcatgaggcacgtgtaaaaggagtcgaggtggcagccagaggtagagctgacttttacaatactctcctcggacacgcagcctgggtcaatgccgtggagcctgcattgggagccagactgcttgccgaggttaaggcactggctgctagagagggcgctgcgcatgtttga

SEQ ID NO: 13885 - RNA, 1467 nt, unidentified
  source 1..1467: mol_type = other RNA; note = synthetic construct
atggacctagcgagccttctggtggaactgaaacccttgattgccgatcctgacgcccactgggggcgcattgccgaattaatggaggagcacagtggcttggcagagtctgaggtggctcgccattggctggccgaacggttagctcccaccctcgtcgccagaagtaggtccagagatccaagggatcgtctgcgggccgttgaagctgctcgttgggcacttccggcgcgtgacttggctggagttttgtggcgcctcgctaaggacccctttccgaaagtgcggcacagagccgtgtccctgacccgatcagagggcctcactgacgttgcccttccagaccggttgggacgaggggctaaaccgaaggcccgcatggaccccttcaccaagaagatcagcgtggtggccctgcgcgatggagaagctcagcgaggctggttcctcctggacccagataaggtgagatctctaagaaggggacggaaaagccctgcaaaacctgatctgccaaagctcaagaaccctgccgacgtggcgacactgttaggatgcgcctccgataaggacctggtcaagttgttgagagtgggggaaggccctggttcaccctatgtccgcttcactataccgaaggccacaggcggcgaaagagttatcaccgcaccccgaccagccctcaaacgggttcagcgtgctctgctcgacaagatcctcgccaaacttccagcccatccctcagcgcacggatttgtagcagagcggtctgtggtaaccaatgctacacctcataaaggtagtgcattagtcgtcaaaatggacattgaggatttctttccaaccctgcactaccgacgcgtggagggtttttttcgccagtattatctgggccccgttgccaaactgctggctggcctgactactcaccggacaagactcgaggatggttacgtggtgtttcccggcgaactgccacaaggggcacccacatcgcctgctctagccaatctcctttgccgacgtatggatgcaagactgacagggctggcggctaaggtgggcgcaaggtacacgaggtatgccgacgacctgacgttttcttggcccgtggaccctgaagtgccacttgggcgcttcttctggtgggtggatcaggtccttcagcaggagggttttgccgaaaacgccggaaagaggagagtactgaggcctcaccaacggcaactcgttaccggggtagtagtcaatcacactctgcatcttccaagggaggtgcgcagacgcttccgggcaatcctgcataactgtcagaagcatggggtggaatcccaggcaaggggaagggaggatttccgggactacctccggggcttcgctagctgggcagcaatggtcgatcctgctgagggaaggagattccaggaggaggtcagggccctattaggcgcggccgttaccccctga

SEQ ID NO: 13886 - RNA, 1470 nt, unidentified
  source 1..1470: mol_type = other RNA; note = synthetic construct
atgagcctctcgaatttgctgctggagttgattcccctgtgcgaaagcctggacgataattgggaacaggtcgtcagcctactggacgctcaccaagatctcgcagagtatgaggttgcacgcttttatgtgagcagatttacatctcggactatccagcagttggtgcggagtgatgacccacgtcagcgagttaagagcgcccatatggtgagactgacatgtacccagagacaagctgggcagtttctcaggttgctgattaaggacccttgtgcccgtgttcgatcagcagcccatagagccatgagaggtctgaggctggacgacgtggccttgcccgacagcaggattaaaaaacctcacccttaccgaggacagctgctcggcggctggaatccctctgggtggagctacgggctgtttggaaacatgtggtcaatcaggcagtacagaaagcagtctaggaaacccaaaaccacactggccgatctcggcgtccctaagcttgaaacccgcaaggatgtgctttcctggcttaagctgggttccattcgggatcttcggaaactgcttagggccggtagtggaccggggtcaccttacgtttcctttactatccctaaggcgtctggggaacccaggactatcacagctccgcgcctgactctgagacgtgtgcagagacagatcctcgacgagctgctgtcaaaactcccaacccacacggccgctcacggattcgttaagaaacgcagcgtggtaacaaatgcaaaacctcacgagggcgcccaactcgtggtcaagttagacctgaaagatttcttcccaacgatatcctatcaccggataaggggcctattgtgcagatatggcttctctccagaggtcgctgacaccctcgccggtctaactacacatcgggcggtactctcagatggctatgtcgtttggcccggagtgcttccgcaaggcgctccaaccagtccagtactggcaaacctgatctgccggagactcgatagtcggttatccggacttgctaagaggatgggcgctcgctatacgaggtacgcagatgacctgaccttctcgttcgcaaaaggtttagaccataagaacgatttagggcgtttcctgtggtgggtgaaccaggtgtgccagcaagaagggtttgccgagaacgtgggcaagcgaaagatcctccggccaagtgcgcagcagcgcattaccggagtggtagtgaactctggactttccgtgccccgcgccatgcgaaggaccttcagagctattctacataattgtcgaatgcacggcttagactctcaagcccgcggacgccgcgattttcgggcttacctgctgggctacgcatcctacatacagatggtccagccctccttggggaagagagtcctcgcggaggtgagggccttgctgactgcctcagaccggcctagcacatga

SEQ ID NO: 13887 - RNA, 1464 nt, unidentified
  source 1..1464: mol_type = other RNA; note = synthetic construct
atgagcctttcgagtctgctcttggagctgatacccctgtgtgaaagcctagacgataactgggagaaggtcttggctctcctcgatgcccataaagaccttgcagagtacgaagtagcacggttttacgtcagccggctcgcttctcggcagctagaccagctcgtgcagtctccagatccaagaaggagaacacaagctgcccactttgtcagactgtgctctacccaacgccaagccggccgttacctgcgagtgctggtcaaggatcccaatggccgcgtgcgatccgctgcccatcgaagtatgcgcgcactgcgcatagacgacgtggccctgccagatggaagatttaggccctcacctcacagacaggcacttggcggatggaatcctacaggctggagctatggcctgttcgggaatatgtacttcgtgcggcaacaaaaggggaagcagcgcaaacccaagcccacactgtcagacttaggcgtgctcaaactccagactcggaaagacgtgcttcagtggcttcagattccatcgctcacagaccttcgtaagctgttacgggctggctccggtccgggttctccctatgttagcttcacgattcctaagagtagtggtgaaccgaggacaatcaccgcgcccagaatgacgctcagaaagttacagcgcaagatcctggatgacctgctgtctaaattgcctacacacgcagcagcccacggattcgtgaagaaaagatctgtcttaaccaatgctaaacctcatcagggggccaaactcctgattaagctggatatcaaggactttttccccaccatttcctattatcgtgttagggggcttctccgcggatatggactgtctttcgaagtgtgcgatacactggctggactcatgactcatcgccccgtactatccgacggctacgtggtgtggccaggtgtattgcctcagggcgccccgacttcccctactttggccaacctaatttgtatgaggttagacgcgaggctttcagggttggccaaaaaagttggagcacggtacacgcggtatgctgatgacatgaccttttcattcgcctccgggatggataaccactccgatgttgggagatttctctggtgggtaaatcagatctgccagcaggagggatttgcggagcatgtttctaagagaaaggtgctgaggccatcaagtcagcagcgcgtcactgggatcgttgtgaacagcggcttgagcgtccctcggcagctgagaaggaccttccgggcgatcctgcacaactgtcggacccacggcgtggctagtcaagccagggggaggaggaacttccgtgcctatctgctgggatacgcttcctacctgcgaatggtgagcccagaattgggtacccgagccctgactgaggtccgagcactactgggctcagatgagtcaagctccagctga

SEQ ID NO: 13888 - RNA, 1479 nt, unidentified
  source 1..1479: mol_type = other RNA; note = synthetic construct
atggacgttgcaaccctggtaagcgccctcatgccattgctcgatgacccagtcggcaatagtgccagaatcctgaagctcctgagagatcacaggacattagcagactatgaggtggctcgattcctcgtcgccaagagaaccgaacccttcgtctgcgagctgctgcagtcccaagatcctaagtctaggcggactgctgtgaggtgggtcgggctaacctttgcgcgtgctcccgctgcaagagttctccgggacgccacaaaagacagagcaaaaatggtccgccaggcagcctttcgtgccactcgggagctacggctggatgatgtggccttgcctgacacaacagatcacgctgcttgggttcacgaggccccccagcagcgacgaatgaaccctttcactggagaggaaatggtggttagaggttcaccccccagggcagccaggcaaaggggttacgacgtgtccggctggcgcttcgggctttacccaacggtgaatcgccgtcgggatcctaaaccggcttttagtgcgctccggtcacgcgaggacgtcgagagagtgctaggcgtttccagagcccagctttcaaggatgattcgtcctggtcatgggtccggccggccctatgtcgcattcgagattccaaaggccaccgggggagtgcgcacacttcatgcgccaagacctgcacttaagagggtgcagagattaatacttgaacgcctgctggcacccctggaagtgcatgctgccgcccatgggtttgtacgaggcaggtcaaccatcactaacgctatccctcatgttggcgctaggatagtcgtgaagatggacttgatcgacttttttccgaccattcactttggtcgtctggtcggactgtttcagcactacggcgcgtctgttgatgccgctaggacccttgccgccgtagtgacctatagacccacactgccagatggacgggtgtcttggcctagcgtgttgccacagggcgcaccaactagcccggtgctgtctaacttggtgtgtcggagattagacagccggctgacagcactggctgcttccgtcgctgcccactacactcgctatgcagacgatctgacgttctcgttccgcgaagaacctacgaagggattaggccacttcctctggtgggtgaatcagattattggacaagagggattccgcgaaaacctagggaaacggcggatcctcaggccaaccggtcaactgcgcgtgactgggctcgtcaccaatagtggcctgagcgtaccgagagacgctcgccgacgctttagggccatcttgcatgattgccgtcagcggggagtaaccgcggaggctactgggcacgaagagcccagagcctacctcctgggtttcagcgcctacgtgcagatggttcagcccgcaacaggcgccaaactgcgagccgaggtgttggccctgcttgcgaggcgatga

SEQ ID NO: 13889 - RNA, 1473 nt, unidentified
  source 1..1473: mol_type = other RNA; note = synthetic construct
atggacattgccactcttgtggccaccttgatccccctgctgggcgatcccgaaggaaacggcgatgagattgtcagactgttggataggggcagggccctggctgattatgaagtggtgcgcttcctggtggcaaagagaactgaatcctttgttcgtcggctgctggaagaccctgatccaagggtccgcaggacaggcgtgcgatgggttgagctaacattcgcacggtcaccagccgccaaatctctccgcgacgctaccaaagaccgggcaaaagtggtgagacaggccgcttttagggctacccgagcccttcgcttggacgacgtggctctccctgacttgcgggtaccatttagatctctgccaggagaaagtcggaccgcaatcaatccatttacacagaagccaatggtactggaagcctctgcttcccgtcagagacatcggggctttaatcctactggctggcgattcgggctgtaccctgtccccagaaggccaagacggccttcacccgaactgtcagcgctgaagtcccggcgggatgtcgaggtgctgcttggtgttaccggcgaggagttagctcccttgctcaggcccggtgctggtagaggttgtccctacgtagcttttgaagtgcctaaggcctcggggggcacaagaatactgcacgcccccagggctgcccttaaacggctgcagcgcattttactgaagcagctcctcgcgcctcttgagctgcatccggctgcccatggattcgtgccgggacgaagcacagtcactaacgcggcccctcacgttggggccaggatcttggtgaagatggacctagttgacttcttcccaactgtccacttcgggcggctcgttggcctgtttgaacactatggctgcgccagggaggccgcggaagtcttagcaacgatagtcacattcagacccgtactccccggaggtagagtggcctggcctagcgttttaccgcagggggcacccactagtccagttctcagtaatcttgtgtgtcgtcgcatggacgctaggctggctgcactagccacgaaggtcggggctgtgtacactcggtacgccgatgatctgacctttagccttcgcgaggcaccttcccagggcctaggccatttcctctggtgggtgaaccaaatcatcggacaggaggggttcgtggagaatctgcgtaaaagacgcgttttgaggccggcaggtcaaatgcgggtgaccgggatcgtcacgaacacacagctgtctattccaagggaggcacgacgccgattcagggccgtgttgcacgattgcgagcgacgtggagtgagccccgaaaccaccggacatgaggagccccgcgcgtatcttctcgggtttgcggcatatgtggccatggtccaaccagagctgggagcaaaactgagaaccaaggtaagagctctcctcgcccgcccttga

SEQ ID NO: 13890 - RNA, 1473 nt, unidentified
  source 1..1473: mol_type = other RNA; note = synthetic construct
atggacgtggctacgttgataagcaaactgtaccccctcctcgacgatccagtcgcaaacagttcgaccatcctgtctctgcttcggcgtgggggagggttagctgagtacgaggttgctcggtctttagtttcaaagcggaccgagcctatggttcggcaaatgctggccgaccctgatccagtggtgagacgacgcgccgtcaggtgggtgcagctcacatttgcatactcccccgcggtccgcattgtgcgtaatgccgcgaaagacaggtcccggatggtgagatcagccgcctttagagccgcccgagcactgagagttactgatgtggctctgcctgcccggagactcgccaaagtgcctgcgaccacgcagcgcgaaggcatcaatcctttcactcgggagcgaatggtaattgccgctcgcagcccatccgtgagggaaatcagggggtacgcccctgcgggctggcattttggcctgttcagggcaaggccgcctagcagacgaccagcaccacctctcgctgcactgaagggccgccaggacgtgttggagcttttgggcgtctccgagcaagaggtcacccgtctccttagaccgggaagcggacccggtacctcttacgtggctttcgaaataccgaaggccagtgggggggtaagaactttgcatgctcctaaacacgtgctcaagagactgcagcggaagattgccactgagcttctcgatcccatcgagccgcatgctgccgcacatggtttcgtgagggggaggagcacggtcacaaacgcccagccacacgtcaatgctcgcctacttgtcaagatggacatcgctgacttctttcccacagtgcactatggccgagttgttgggctgctggaacaccacggagcgggaaaagaggcagccaagctactggcagctattactacatatcgccccaaactcccagacggacgagtgagttggccctccgttttaccccaaggggcccccacatcgccagttctgtcaaacttggtatgcaggcggttagatgccaggctaaccgcactggctgcccggttgggagcaacatacacccggtatgccgacgatctcactttcagcttccagggggatccagagcagggtctgggacgattcttttggtgggtcaatcaaatcctgcaccaggaaggcttcatagagaacatcggcaagagacgcgtgcaccgcccttcaggccagatgcgtgtgacaggtctggtcactaaccagggtctgtctgtgccacgggaagaacgcagacgctttagggctattcttcacgcctgtgaacagcgtggagtctcttccgaaaccaccggccatagtgaacccagggcctatctgctgggctttgcggcatatgtggagatggtgcaacccgaggtaggcaaaaagttgagagctcaggtaaagaggcttctggcaaaaagctga

SEQ ID NO: 13891 - RNA, 1461 nt, unidentified
  source 1..1461: mol_type = other RNA; note = synthetic construct
atggacctggccaagcttcttttcaccattaagccactcctcgctgatcctagggcaaacctggcaaaaatagtagagctgctggagaagcataacgacctggccgaatacgatgtggcgcgcttctacgtgagcaaatctgtgcggcctgcaattgaggaaaaactgagttccccagacccaagagagcgaactgccgccacaaagagcataccccgtctgatggggaaaagtgaaggagccgctctcctacgcagagtgtacaaggatgcatccccaactgtgcgtgccgctgccaggtctggggtaagcatgttgggcatcgaagacgtggcgttgccggactcgaggtttcccgctcctcgaaataattggcagagacagggaggttggaacgaaacaggatgggcctttggtctggctgacagccgcgctcgcaaaccaaatcggcgggtacccgaggacattgccagcatccggaaggtttttaaggagctgcagacctctgatgatgtcgccaagaagctaggcatgaaaaaagccaaggagttgaaagccttaatgcggcccggacaacaagccggctcagggtatgtggagtttacggtgcctaaagccactggcggcttacgcaccatttgtgcaccgagagcccccctgaaacgggttcagagaaccattctccgcgagctgcttgcaaaagtccctacacatgacgctgctcacggctttattaacggacgatcagtggtcagtaacgcgcgtccccacgagggagccaagatcgtggtgaaaattgatctcaaggacttcttccccactgtgcacttctaccgggtggctggcacactcaggtacttagggatgggagaggctgccgctagtaccctggctgccatcgtgacccacagaaataagctgcccgatggtacagtcgttatgccaggggctttgccacaaggcgcacctaccagccctgcaatcacaaatatcgtatgcaggaggctggatgcccgattggacgcgctctctaaaaaggtgggagctaagtatactcgttatgcagacgacctgactttctcatttcgcgatgaacctgaaaaaggtcttgggcgctttttgtggtgggtcgatcaggtcatccagcaagagggcttcgttcagaatgcccctaagaggcggatcctgagaggctccaaccagcagcgaataaccggggtagtggtcaatgatggtctttccgtgccgagagacgcccgcagacggtttagggctatgctcgagaacatcaggcgaacgtcagttgatgaacaggcaagagggaaggcggatttcaaggcctacctgaaaggcttcgcttcctatgtcaagatggtgcagcccgaggttggtaagaagctactcgcagaagttcatgcagtccttgccgaagacgtccggaagagggacgcggcaaaatga

SEQ ID NO: 13892 - RNA, 1443 nt, unidentified
  source 1..1443: mol_type = other RNA; note = synthetic construct
atgaacttaccggctcttctcttagagctgcgccctttggtggccgacatagacaagaactgggacagaatcgtggaactgctctcaactcacaagcgtcttgcagaatacgaggttgccagattttttgtggcgcggcacgtcgaaagccgagtgaccgaactcttgcgcagtagagatccccagcagcgtgctcggggggtcaagatgctcgagctagcatatccatccacccgggccgggaagcatttacggcatctagtgcgggatgctgacgtcgaggtggcacgggatgcaaccgaggctgtcagtaatctggatatcgatgacgtggctctgccggatttccgcctgaaaccgccaagggatcctcggcatggatggggtgggtggaatcagagcagctggcggttcgggtttcctctcgccgactgggtaagaaggaaaaagcgcgtcgggcccaagaagctcaaactccccaagatcgccgataaagccgctttgttcgaactgttgggtatagccgacgagaagcactacaaaaggctgattaggccaggagctcagtctggcgccccctatgtggaattcacagttcctaaacgatcaggtggagagagaattatctccgccccacgggctgaactgaagcgcgtacagcgaacaattctggacaaaattctggccaaaattcctgtccacgacgccgcacatggcttcgtgcctggcagatccactgtgactaatgcgcagccccacgtaggggcttcccttgtagttaagatcgaccttaccgagttttttcccagcatccatttccgaagggtgtatggcctcatgggttactatgggtacgaacacgaggttgctacagccctggcggccctgatgacgcacagaatcaaactcgatgacggaaagaggatggtagaaactggccttgttccacaaggagctccaacgagccctgccctggccaacatagtgtgtcgcaggctggatgcaaggctctctggattggcacagcgggcgggagctcgatacaccagatacgccgatgatttgacattcagttttgccgatgcaccccctgacaagggcctaggcaggttcctatggtgggttgacgcagtgtgccagcaagaaggctttgtcgagaatgcgggtaagagacgcgtgctgaggccctcgcaccagcagagagtcacaggcgtggtcgtgaactcacaactgtctgtgccccgttctgaacgtcgaaggtttcgggccatgcttcataactgcagacataaaggcattgccagtcaagcaaaacagcacggacgcgacgaggcagagttccgcgactacctgaccggcttcgcttcctatgtcaaaatggtgcagccagagctggggaataagttagccggcgaggttgctgacctgctgaagggagcatga

SEQ ID NO: 13893 - RNA, 1437 nt, unidentified
  source 1..1437: mol_type = other RNA; note = synthetic construct
atgctgctgccaaacctgatcctggagctgcgcggactgctcgatgatcctgaggcaaagctcgagaggatcgtcgagcgcctcagggcacatgacgacctagcggagtacgaggtcgcgcgccattacgtggctaagcggttggaaccagtgatccgtgcttggttagcctcgcctgacccacgagtcagggtcgaggctatcgccgccgtgcgacaaaccttttccaagcctgctgccgcgaaggtgttaaggcacctcgtaaaagacgcaaccctgtccgtaaggggcgcagccagaagggcagtggcagaactgggactcgatgatgtggccctcagaaacacgaccatgcgcgaaccccgcaggagttcatggcctggtggctggaacccaagcggatggcagtttgggacggggcggaatcgtggacggcctaagcttgctccagctcccgttcgggcagggttaccggcactggctgacgtggacgccttggctgtgtggttgggttatgagggcgcaggcgaactgcggagattcatgcgacccggtagcgaaaccggctccccctacgtggatttcgagatagccaaagcccgaggaggccagcgcactatatccgcccccagagcgcccctaagggctattcaaagaaagatttacgctgaactgttagcaaaagtgccagtccacgatgcagcccacggattcgtagtcggcagatctactttgacaaatgctgcccctcacgttggggcaggcctgcttatcaaaactgacatccgagagttctttccaagcatccattattggcgggtgagagggctttttttttcactggggtatggcgaagaagtggcttgggccttggccgccttgtgcacaagacgccccgttattgaccccgagggggagagacgtgttgcttggcccggtcttctgccgcaaggagcccctacaagtccagcgcttgccaacctggtttgtcgacgcctggatgccaggctgtctggcttcgctgccaagattggcgcaaggtatacacggtacgcggacgatctgtcattctctattcacgatccgggacgggcacagggattggaagtggggcgcgtgctttggtggatagaccagattcttcagcaagaggggttcgccgagcatcccggcaaaagacaggtcctccgcccgcataggcgtcagctggttaccggaatcgtcgtgaatgatcaccctactgtgcctagagatgcccggaggcgcttcagggccattctacacaatgtagctcggagagggctcgccagcgaagctcgtggtcgagacgactttgccgattatctccggggctttgccgcatacgtggagatggtccagccagaactcggtgctcggtgggttgctgaggtagacgcgctgctgcagagtgcctga

SEQ ID NO: 13894 - RNA, 1422 nt, unidentified
  source 1..1422: mol_type = other RNA; note = synthetic construct
atgctgctggcagacctgattctcgagcttagagagctgcttgtggacccccgagccaatttcgaggtaataatcgaccgtctggctgcacacgacgacttggctgagtacgaggtcgccagacaatacgtggttcccgccatcgaaggcctaatccgcgaaagattggacgaccccgatccacaggtgcgcgtacaggccattgtggcggtgagacagtgcttttcgaggagcgccgcggctaaactccttaggcatctggtcaaggacgcgaacctgagcgtaagaggagccgcacgcgaggccgtgtcttctcttggcttcgacgaagtggctttaccgaacgctgattttaaccctcggcaccagcgctggaatttgggcggctggtacttcggtacaggggactggagaagacctggcttggctccacaagcagtccgggcagcccttccaagtctccccgatgtggccgctttggccagctggctcaatattgatgatcctgctgagctccgacggtttatgcggcccggtagtgacaccgggagtccctacatcgatttcgaaataccaaaggctaagggcggagtgcgggtcatatctgccccaagagctcctctgcgagcaatccagcgcaagatttatgccgagctgctggcagcaattgccaaccacgacgccgcccatgggtttattgccggccgcagcacagtctcaaacgcggctcctcacgttggcgctaggctggtactgaagactgatatccgggaatttttccccactgtgcattattggagagttaggggactgttcagatggctgggattagggtccgttgcaggcgagcttgctgccctgtgtacacgacgacccgtggtcgagcgtaacggccaacggatggttgtctggccgggggtgttaccacagggagcaccaacgtcacctgccatcgccaatctcgtgtgtaggcgcctagacgctcggctccagggtttggccgagaggctggatgcgcgctacaccagatacgccgatgatctgaccttctcattccacggatccgacgggggtggagaacctggagtggctgtagggcgggtgttttggtggattgatcagatcttacagcaggaggggtttgccgagcacgcaggtaaacgccaggtgttgcgacccggtggaaggcagctagtgaccgggatagtggtcaatgaaaggcaatccgtcccaaggccggttcggcgcaggttcagagccatcctgcataattgcaaacgtgatggactggcatcccaagctcatgggagggatgacttcgcagactatctccggggctttgccgcgtatgtgcagatggtccagcctcagctgggccaacgttgggttgcggaagttgaagcactcctcgccggcaggtga

SEQ ID NO: 13895 - RNA, 1446 nt, unidentified
  source 1..1446: mol_type = other RNA; note = synthetic construct
atgctgctggcaaatctcattttcgaattgcgacccctgctcgatgacccagaagctaacctgaggcagatagtcgctcggttgcgggcccatgacgacttcgctgagtatgaggtcgcaagacactatgtggcgggcaagctggagggggtgattagatcgtggttagctaaccccgatccgcgggtcagagctgaggctattgaggcagtacggcaagtcttctcccgtcctgccgcggctaaactgctacggcatctggttaaggatgccaccatctcagtgagaggagcagcaaggcgagcagtcgatgagctggggctggatgatgtcgctctccgcaacacttctctcgcagttccacgatctcctaggggcaggggggggttcaatcccaccggatgggaattcggcactggtgcccatcgtggacgcccaaggcttgaacctgctgccactcgtgcgggattgcccaccatcccagatctagcagccttaacctcatggctccgcatcgacgctgacgggcttagacgcttaatgaggccgggcggccatacaggagccccttatgtcgatttcgaaattcccaaagccagaggaggccgcaggaccatctctgcacccagagcccctctgcgcgctgttcagaggcagatactggcggagatcctttccaaggtgcctactcatgatgcagcccatggtttcgtgccaggccggagtaccgtcacacacgcaaccccccacgtaggagcacgcctcttgctggccacagacatccgggacttttttcctacaatccactattggcgagtgcggggactctttttcaccctcgggtacggtgaggctgttgcaggcgctctagcggcactgtgcacacgcagagacgtgataaatcccgaggccgaagcccctacgaggagggtagtttggccagggtggatgccccaaggagccccaacatccccagccattagcaacctggtctgtcgtcgcctggatgcgcgattaagtggcctggccgccaaactaggtgcccggtacactcgatacgccgacgacctgagctttagcttccacgacccggaacttgtggagaggctggagatcggtcgggctttttggtggatagaccagatccttcagcaggagggctttgccgaacatctcggaaaaagacagattcttcgtccgcacagacggcagctggttactggcttggtggtgaacgaccaccttacggtgccaagggatgcgcgcagacgctttagggccattttgcacaattgcaagcagagaggtgtggccagcgaggcaaatgggcgagacgacttccctgattacctccggggctttgctgcttacgtgcacatggtgcaacccaagttgggggctagatgggtggccgaagtagacgccctgctggtggatcacgcctga

SEQ ID NO: 13896 - RNA, 1491 nt, unidentified
  source 1..1491: mol_type = other RNA; note = synthetic construct
atgctgctggccaatttgattctggagttacggcccctgctggcagacccacaggctaatctgccccagattaccgccaagcttagagaacaggaagattttgctgagtacgaggttgctaggcattacgtcgcaaagaagctggagcctacaatccgcgcctggctggacgatcctgaccctagggtaaggctggaagctatcgccgcagttcgacgaacgttctccaagcccgccgccgctaaggtactcagacatcttgtgaaagatgcccacttacgtgtcaggggggtggctcgggaagtcgtattcgagctgggcctggatgatgtcgcccttcgggataccacttttagggtgccacgtaatcctgctggcggagggggatggaacccgtctggatggcactttggcaccgggtcccaccgaggtcatccaagactcgcgccagaagcagtccgcgctggtctacccgacttgcccgacctgccagcccttctgcggtggttgagccttgacgacgaggccgcattgcgacggctgatgaggccaggatcagccgctggagccgcttatgtggatttcgaagtcccgaaaaaatcgggtggcacacgcctaatctctgccccccgagcgcccttaagagccgttcagcgcaaactgctggcagatatcctggcccctgtaccttgccacgacgctgcgcacggctttgttccaggacgctccacagtgactcatgcggcgcagcatgtgggcgccaagcttctcctccagaccgatattcgggatttctttccctcaatccacttttggcgcgtccgtggtttatttttcactctcgggtatagaggcgacgttgcacgcgcactcgcagcactctgtactcgtaggcccgtgattgccgccacaaggacagacgagcggagagtcgtgtggccaggggttctacctcaaggagccccgacgagccccgcattgtccaacctggcatgccgccgcctcgatgccagattaagtggactggcagctcggcttggggctcggtattctcggtacgccgatgacctgagcctgagcttccacgacgatgaggccctcgccaagctagacgtgggcagagcattctggtggatcgaccagatactccaacaggagggcttcgctgagcatcctaagaaaagacggattttgaggccacaccgaaggcagcaggtgaccggaatcgtggtgaacgaacatctggctataccgagagacgagaggagaagatttcgcgctatgctgcacaactgtagggcgcacggcttggacagtcaagcaaaagtgtgggcccaagccagaggccacgatcctgagcatgaaggcctgcgcgccgacttcctggcctatttgcggggttacgctgcttacggggcgatggtgcagcctaagcttggggcacgttggctcgctgaactcgatgccatggtgcagccagacaccccctga

SEQ ID NO: 13897 - RNA, 1365 nt, unidentified
  source 1..1365: mol_type = other RNA; note = synthetic construct
atgaacccggtagaagctatactggagctcgagcggctgaaggccacaaagcccgtggatttggccgccgttgccagggtcctcgaaggagtagaaggcctggctgaggaagatatcgtagggactgtggcattcgagctgatcagcccccgagcagtgtttacccttttaaagagccctgagccctctgaacggttggctggcgtcgagcttgttgcaaggctcgggagactgcatgccgggtcctttctgcgccatgtggtcaaagatcccgaccctcgtgtggcctcatgtgctcgccggcaccttacccgtctgagactgccagaggtcggtctaccactgcctttgccttcgtttgccagggcctttgccagaccgtcctggaccgtcgcaggttggcggtttggagcagcacctcggttctctgacgctagatacccggttcgtgctgacctgagtagtgctgccagagctgaggcgcatctccgagtgcccctggcatctctaccatccctgcgccgctacgccgagtttacagtccccaagagacggggcggcgtacgctcattagccgcacctcatctggcactcaaacaagtccagcgccggcttctggacgcggtgttatccaggcttgccgtgcaccgtgcctcaacggctttcagttctgggagttcagtcgtgaccaatgcggcggctcacgttggcagagccatggtcattaaactggacctgcaggattttttccccagcattcacgaagagagggtgcgcggattatggggagcactgggggctgatcgccaagtagcccacgccctcgctaggctaacaacatatagaccacgccttgcgtccgggagcttgtccaccgtggcagtgcttccacaaggggcccccactagtccagccatcgcaaatctcatcgccaggaggttggacgccagactggctggtctgtctaaaaagtggaaagcttcctacaccaggtatgcggacgacctcacgttctctttcgccgaggagcctagacaggttggccggttcctctggtgggccaacgccatttgccagcaggaaggattcgtggagaacgctagcaagaggcgagttatgcgagccactggccggcaacaggtgacaggcctggttgtgaatcagagggtgactttgcctcgacacgtcaggagaagcttcaaggcaataatccataactgcgaacgccacggcgtggctagccaagctagaggacgacccgactttgaacagtggctactgggtttcgctgcgtgggcagccgtggcacaaccagatgtgggagtcgattggctccggcgggtgaaacaggttttgggccgttga

SEQ ID NO: 13898 - RNA, 1551 nt, unidentified
  source 1..1551: mol_type = other RNA; note = synthetic construct
atgagtgcctcacagtccgccccagcgtggttgttgcttcccttacccgctaatgcagatgctgacgccatcctgatcgcaactattgagcaatatgcaaccagtcttccgcaggagtttaaaaagcttcacgacgcactggacgaagtgcgggcactagcgagctacgagccggctgtaaatagaagcaacaccctggtctgggagaagttggagacattactgaccgctccggaaggaacagcacggatcgctctgattagatacgctcgggaacatatgccagagcgggcctgcgccagggtgttaaggagactggccaaggatgccgatatgaatgtcaggcgtaccgtggctaaggccattcggaaggcgaagatacaggaagtggctattcccgccaagaaagacggcgattgggatccctctggttggttgctcccagatgaagtgtcaaaagtgacgcggcataaaactggcaagagagcccaggagaggtccggcgtacctgcactgactaagctggccgaactgagaaaactcctcggaattaagtccaccaatcaactgggtttctttttgctcgcatccgatcacaaaggaggcccctacacaactcataaaatccctaagagggacggctctgatcgccagatatgcgctccaaaaaagcaactgaagtgggtgcagaaacagatcctgaaacacatcctcagcaaagttcccccgcaccctgccgcacacggttttgtgtcgggccggtctacggtatcaaatgctactccacacgtgggggccgagctggtggtcaagttcgacctgaaagatttcttccctacagtgcattattttcgagtgatggggctttttgccagcctcggctatccagttggtaactgtatgtttggaactgacgatggcgcaaatcagatcgcccctgtcctggctcggctttgttgttacacccccgatcctaagcagtggggctctgcagcattgcctcagggggctcctacaagccccgcgatctcaaacctggtttgtcgccgactggacgccagactccaaggccttgccgagacgaaccacggcacctacacaaggtatgccgacgacctgacattctccttcccaaaggctgagggaatgaacttagggaggttcaggtggtgggttgaccaagtctgccagcaggaaggcttcgtcgtcaatcaggagaagttccgtgtgattcgcgacagtcagagacaggtcgttactgggatagtggtcaacgatgcagtaagagctccccgtgaactccgcagagagattagggcgatcctccataactgcgaaaccaaagaccttgagagtcaagctaagcgacaccctcgctttcgcggaaatgttccagcctttagccagtacctccgagggatcgccgcctatctaaacatggtgcaacctgaacatggagccgcgttgctgcgacgcgtgaacgaactactggggggacccatagagggggataccccatctcaggaccagggtaaagctggagacgcctga

SEQ ID NO: 13899 - RNA, 1548 nt, unidentified
  source 1..1548: mol_type = other RNA; note = synthetic construct
atgagcgcaccccgttccgcccctgcttggttactgttgcccttacccgcaaacgctgatacggacgctggactcatcgccacagtcgagcagtattgcgcaacactacccgaagcgtttaaaaaattgcacgatgcactcgaccacgtaagggcactcgccagctatgagcccgcggtgaacagggccaacgtgcttatatgggagcatctggaagccctgctgtccgccaccgagaagaaggcaaggttggaacttatacggtacgcccgcgatcacttcccggaacgggcttgtagtcgggtgctgcgacgcttcgccaaagaccctgacatggaagtgagacgtgtcgtggcacgggctgtgaggaaagccaaaattgaggaggttgcaatccctgctcagaaggacggtgactggaacccaactggttggctgctgccaagcgaaggcctgaagataacccgacataagcctggcacaagaactcaggagcgctctggtgtgcctatcctcgggaagctaaaagacgtgcgaaaactgctgaacattaaatctcccaatcagctggggttttttcttcttgcctctgaccataagaatggtccatatacaacgcacacaattccaaagagagatgggtctgaaaggaagatctgtgcacctaagaaacagctcaaatgggtccagaagcaaatcttgaaacacattctgagtaaggttccaccccatccagcagctcacggattcgttaatggtcgatcaaccgtgtccaacgccaccccgcatgtaggcgcggaactgatcgtgaagtttgacctgaaagactttttccctaccattcactacttcagggtaatgggactttttgcatcgttcggctaccaggtcgacaactgcatgttcggcactaaagatgatgccaaacagattgcccccgtgcttgctcgcctgtgttgctacacccctgatccaacacagtggggaactgccacactccctcaaggggcccccacctcaccagctataagcaatttggtatgcagaaggctggacgccagactcatgggactcgcgaaggctaataaggggacttttaccagatatgccgacgacctgaccttctccttccccaaggccgaggggatgaacttaggcaggtttcgctggtgggtggatcaggtctgccagcgcgagggatttgtggttaaccaagagaagttcagagtgattagagactcacagcggcaagtcgtcaccggcatcgtggttaatgatgccttgcgagtcccgcgggagctgcgtagagaactacgggctatcttgcacaattgtactactcatgatattgagagtcaagccaagcgccaccccaaatttaatggcaatgttccagctttcacgcagtacctccgggggatcgcagcttacctgaacatggtgcagccggaacatggaggcgcgctccttaggcgcgtgaacgagttactgggagggcctatcgagggcgctgatgagacaccagatgtcaaggccggcgatgaatga

SEQ ID NO: 13900 - RNA, 1551 nt, unidentified
  source 1..1551: mol_type = other RNA; note = synthetic construct
atgagtgcgtccccctcccctcctgcatggctactgctccctcttccagccaatgccgcacacgacgccgccctacttgcttccgtcgaagaacactgcactaagctgccacgcgacttcgctaagctccagaaagctctcgagcgcgtaaggtacctggcaagctatgaaccggccgttaacagggccaatgcactggtctgggaacagttcgaggccttacttagcgctccagaaggtcgggacaggatcgcactggtgggctacgcaagaaaccacatgccagtccgggcattagcccgcgtgttacgtcggctcgcgaaagatcctgatatgactgttagggggcagatcgcttatctcatcaaaaggtctaaaattcgcgaggtcgccctgccggctaagaaagatggtgattggaacccaaccggttggatgctacctgcagagcgggggcgaccaagtcgaattaccaggcacaagaccggaaagtccgtacaggcccggacaggcgtgcccttgttagccaagctggcacaactccgagccctgctgaatatcaagtctccgaagcagttgggctatttcctgttggcctctgattacaagaacggcccctatacaacacatgtaataccgaagagagacggcagtgatcgtaagatttgcgcacccaaaaaacaactcaaatgggtccaaaagcaaatcctgaagcatatcctcagcaaagtgcctccacaccccgctgcccacgggtttgttaacgggcgcagcaccgtctctaatgccacgcctcacgtgggtgccgagcttgtcgtaaagtttgacctcaaggacttttttcccaccgtgcattttttcagagtgatgggactgttcgcgagcatcggctaccccgtgggcaattgtatgtttggcactgatgacgattccaatcagatagcacctgttctggctagactctgttgctacacacccaaccccaagttgtggggttcagccacccttcctcagggggctcccacaagtccagccgtgagcaacctggtgtgtagacgtctggacgctagactggcaggcttggcagaggctaacaaaggaacctatactcgatacgccgatgacctgacattctcattcaagtcagcggagggaatgaaactgggccgattcagatggtgggttgaccaggtctgtcagcaagaaggatttacggtgaatcagcaaaaattcagagtcattcggtcttcacagcgccaggtggtgaccggcatagtggtgaacgcagggttgcgcgtgccaagggagcttcggagggagctgagggcgattgtgcataattgcgagaaacagggcgttgaatcgcaggcggctcggcatcccaattttgggggaaacgttggcgccttcactcagtatctacgcgggattgccgcctacctgaatatggtacagcctgaccacggtgctgctctgttgcggagagtgaacgaacttctcggaccagccgctgacgcggatgatgctgaggccaagggagggggagcctga

SEQ ID NO: 13901 - RNA, 1548 nt, unidentified
  source 1..1548: mol_type = other RNA; note = synthetic construct
atgagcgcaacgactaggaccggcccggaatggctcttcaggcctctgcctgcaaacgccgaccatgacgacgctgttattaagaaagtggagcagcactgctccaagcttcccaacgagttcctgaaattgcaaaaaaccctggacgatgtccgcgcttttagtagctacgaaccctgtgtgaatcgcgccaatgaacttgtgtgggagcagtttgaggccctggtcaccaatccagatggtaagtgccgtcgtttgctgatcgggtatgcgacagctcacatgcctgagcgtgctgcagccagagtcttacggcgacttgcgaaggatccggatatggaagtaaggaatcatgtgtctagggcactgcgcaagtccaaaatcagggaggtcgccctgccacacaagaagggaggggactgggatacatccggatggcttttgcagagtgaggagactaaagttacgcgacataagccaggtaagagaaccttggaaaaaaatgaactccctgtgctcacaaatcttgcgcagctgcgcaaactcctgaatataaagtcaaccaaccagctcggctattttctgctagcctcggacaacaaagacggcccctacaccacacacactatcccgaagcgggacgggtcagatagaaagatttgcgctccgaaaaagcagctgaagtgggtgcagagacagatcttaaaacacatcctttccaaggtaccaccacaccccgctgcgcacggattcgttaacgggcgcagtacagtgtccaatgccggaccccatgtaggtgcagaactcgttgtgaagtttgatctaaaggaattcttcccaaccgtgcactacttccgggtaatcggactgtttgcatctatggggtatcctgtgggaaactgtatgtttggaacagaggataagagcaatcagattgcacccgtcctggcacggttgtgctgttacacgccagatccaaagaaatggggctctgctgtcttacctcagggcgcccctacaagccctgccatttcaaacctgatgtgccgacgcttggatgccagattagggggcttggccgaggctaacaagggtacctatacccggtacgctgatgacctcacattctcattccccaaagctgagggcctgaacctcggcaggttccgatggtgggtggaccaagtctgtcaacaagaggggtttactataaaccagcagaagtttagagtgatccgcgacagccagaggcaagtggtcaccggaattgtggttaatgacaagctgcaggtgccaagggagctgcggagggaactcagagctatactccacaactgtgagaaaactagcgtcgaggaacaggccaagcggcatcctcggtttactgagaacgttggcgccttcagtcaatatcttagagggatcgccgcctacctgaatatggtgcagcccgaacatggtgcagccctactgaaacgagtgaatgacctgattggcaaacctgagggcgaaactccccccaaagaaggtgagcagtctaaaaactga

SEQ ID NO: 13902 - RNA, 1530 nt, unidentified
  source 1..1530: mol_type = other RNA; note = synthetic construct
atgagtgccactcacacaggcccagagtggttgtaccgtcctctcccggccaatgccgacttcgacccagcagccttagccaaagttgaggaacatgccgcagcattgcccgctgcttttgcaaaattgcaaaccgcccttgacgccgtgagggcccttgcaagctacgaaccttgcgccaatagggccaatgagctggtgtgggagcgattcgaggcactggtggcggacccagatggacatcatcgcgcggctctactgcgttacgcggtggctcacctcccagaaagagcagctgcacgcgtcctacgtaggctcgcaaaagatcccgacgtgagcgttaggacgcgagttgcccgcgcattgagagcctccaaaattcgagaggtggcacttccacaccgcgaagccaacaactgggacacgagtgggtgggttctgaggacggaggataccaaggtgactcgccacaagacaggaaccagggcgcttgaaaaagccggcctgccagtggtgaccaagttagccgatttgagaaagttacttaacatcaagagcactaatcagctgggatatttcctgctcgctaccgacgctaaggacggcccctacacaacgtataccatacccaagagagacgggactgatagaactatctgtgctcctaagaagcagctcaaatgggttcagaggcagattttagaccacatactgtccaaagtacccccgcatccagcagcccatggcttcgtccctgacaggtcaactgtcaccaacgcagggccccatgtaggagccgaactggttgtcaagtttgatctgaaggaattctttcctactgtgcactactttcgggtgattggactgttcgcttctatggggtacccagtcggcgactgcatgttcggcaccgctgacacatcaaaccaggtggcccctgtattggcccggctctgttgttatacacccgacccgaagaaatggggtactgctgtgttgccgcaaggggctcccacatctcccgccatctcaaacctgatgtgcagacgccttgatgctcggctggccggactggcagaggctaacacaggcgtgtataccagatatgccgatgatctcacattctcctttaagagcgctgatggcctgaatctcgggagattccggtggtgggtggaccaggtgtgccaccaggagggctttaccgtaaaccaggctaaatttcgagtaatccgggattcccagaggcaggtcgtcaccggaattgttgtgaatgagaagctgcaggtgcctagagagctccgccgggagcttcgagccatcctgcataatgtcgaaaagacctctgtggcagagcaagcgaaacggcacccccgctttgaaggtaatgctggcgcattcgcgcagtatctgcggggtgtcgccgcctacctgaacatggttcaacctgaacacggtgctgccctactgaaacgggtcaacgagctgctcgggacaggtgatgcggacggagatcctacaccatcgtga

SEQ ID NO: 13903 - RNA, 1566 nt, unidentified
  source 1..1566: mol_type = other RNA; note = synthetic construct
atggccagtgttgtcgccgagattatcagagaacggtggtttcagctgcagattagggccaacgccatgaatgttatcgagcgagctcccgcttggctgcttaggccactccccgtccacgcagtcgctgatgacaagctgaacgacagaatcgacaaattggcggccaagttgcctgagagcctccccagactccaggccgtgctggatggagtgcaaatgtaccgcgagtatgagcctgccgtgaatcgggcaagtgcccacgtttggaacgtcttggatcagcttttcgcggccgacgcagactcagtgagagtgtctctgttggtgttcgcagaagcacatatggtagagccagcccgtgctcgaatttatcgacgcctggtcaaagacccttccaccaaagtccgcaatagagctcgccgcttagtccagaggtgtgacttacacgaagtggcccttcccctccagaaggacggcgactgggatcccactggttggctgaggggggtcgtggataggagactctcccggcatgcccagggcaaacgggttcaggagagacatgacgtccccgtaatcgggacgctggctcaactcaggaagcttctaggaattaggagttctcgccaactaggttattttctactggcgtcagatgcagatgggggaccttatgtaagatttactattcctaagagggatgggagggagcgcgaaatctgcgcaccaaaaaagcagctgagatgggtacagcggcaaatactggacaaagtgctcgcgcaggttccagtccatgatgctgcccacggtttcatagtgggccggtctatcgtgaccaacgcatcccagcacaaaggtgcggagatcatcctgaaatttgacctcacagatttctttccaaccatacactactaccgcgtgttaggcttttttgcatccctgggatacagcgtgggcaatggccgattcgggaccaatgactctagcaagcaggttgcccctacgctggcccgacttgtctgttatactccagatccacagcagtggggcgacgctagactgcctcaaggagctccgaccagccccgctatttcgaatcttgtgtgccggagactcgatgcacgccttgctggactcgctaagcggaacgaggcagtgtacactcgctacgccgatgacctgacattctcattcaggaaggcgaccggcgacttaggccgtttccgttggtgggttgaccagatctgtcatcaggagggattcttggtaaaccagaaaaagttccacgttattcgtgcctcacagagacagctggtgacaggaattgtggtgaacgatgagctgcatgtgccgcgagacgaaaggcgtcggtttcgggccatacttcacaattgcaagacacacggtctggattcccaagctagggggcatgcccaatttgctgaatacctgcggggcttcgccagctatatccacatggtacaaccggacgaaggcgcagaattgttgcaggccgtggaggaactgctcggacctgagacaggggaagatggggtgccctga

SEQ ID NO: 13904 - RNA, 1488 nt, unidentified
  source 1..1488: mol_type = other RNA; note = synthetic construct
atggccgatgtcctcgacgtgccagagtggctcctccgtcctttacctgcgaacgcctctgccgacgcaaagctccacgctgaaatcggaaggctggccagcaacctgccagccagtctggcagagattgccaaagcattggaggccattaagaattactctgaatacgatgcggctgcaaattgggcttccgcacacgtttggcaagccgtggcgaagttcagtgctgccgatttgccgggagtgcgagtgggcctgcttaagttcgccgcggcccacatggtagctaaggcacaggcacagatctgcaggcgcctcgcaaaggatccagctgtggctgtaagaaggagggctcgaaaactggtggagaacgccggttttcatgaggtggccctcccagatacggctgatgggccctgggatgccacaggatggctgcgtggctctgccacaggggtgctatcccggcacaaacagggaacaaaaatacaggcagaaaggggactcccaaagctgagtaccgtgggggagcttaggaacctgattggcatcaagtcagaacgtcagctgggatggtttcttttggctactgacgcagaggatggtccttacgtcaagtttacaattcctaaacgggatcagactgagcgcgagatttgcgctcctaaaccccagctgcggtgggtgcaaagacaaattttggacaaaatactcgcaaaggtggctactcatgacgctgctcatgggttcataccgggcagatcgatcgtaactaatgccgcgccccacacctcagccgccttaatcctaaagttcgacttgaaggattttttccccactatacattattaccgggtgatggggctgtttacctcccttggctacaccgtcggaagggccaaattcagcgccaaagacgatgcaagggaagtggcgcccacgctagctcgcttatgttgttatacccccgatccccaccagtggggttctgccttggttccacagggtgcccctacctccccagcaatcagcaacatcgtatgtcgccgactggacgcccggttgagaggcttggccgaacggaacaagggtgtctatacacggtacgctgacgacctgaccttcagctttctgaaagacgaggtcgaacttggccgatttagatggtgggtggaccagatctgtcaccaagagggcttctttgttaatcaggctaagtttagagtcatccgctgctcacagcgccaagtggttaccgggattgttgtcaatgacgcgctccgaatcccccgggaggaaaggagacgcttcagagcaattgtgcacaattgcaagaaacacggaatcgaagcacaggccagaggccataaaaagttcctggactatctgcgcggctatgccagctacattaacatggttcatcctgaagagggggcagagcttctggaggaagtcgaagctcttgccggcccggagacaggggagtga

SEQ ID NO: 13905 - RNA, 1482 nt, unidentified
  source 1..1482: mol_type = other RNA; note = synthetic construct
atggacccacttccagccgcgcctgcatggctactacgaccccttcccgcgcatgccgtggaggatgagaagctccacgcaagaatagataagctgtgccaaaggttaccagctgggttggcggagctcggcgttgcacttaaggccgttgaaatgtatagggagtacgacgccgccgctaaccatgccagtatccatgtgtggcgtctgctggatcaattttactcatctcccgcgagcgtccgctcacagctgctcaatttcgcccgacagcacatggttcctcaggcccagcacagaattttgcgacggttggcaaaagacccctctctcgccttgagacgcagtgtccggcggctcattgagcgtggagctgtccgggaagtggcccttcctctggaggctgacggcgattgggacgcacaagggtggctgcggggtaacagcctacccctgactcgacacaggcagggaagacaggctcagaccgatcatggtgtaccacggctggctaagttggcagacctgaggaaactgttggacattaggtcggccaaacagcttggctggttcttactcgcaactgatgctgacaatggaccttacaccacttttaaaattccgaagcgaagcggcagtgagaggctgatctgtgcccctaaaccgcagttgagatgggtgcagcgtaggattctcgacaaaatcctggctcctgtagccccccataatgcagcccacggcttcataccagaacgctccaccgtgactaatgctgccgtgcacacgggagcggcagtggttctcaagttcgacctgacagatttctttccaaccatccactatttccgggtggtcgggctttttgcctcccttggatatcatgtgggagacggccggttctcatccgatgatgatagcaagaacgtggcaccgacgttagctcgcctgtgctgttatacacccgatccacaggactggtctgctgccaaattaccacaaggcgcccctacctcccctgcaatctcaaacctatgttgccgcagactggacgccagactgcaaggtctggctgagcggaacgggggcaaatacacaagatatgccgatgacctgacattttctttcgaaaagcccgaactggctctcggacggttccgctggtgggtggatcagatctgccatcaggagggtttttttatcaatcaggcaaagttcagggtgattcgcgcttcccaaaggcaggtcgtgaccggaatagtcgttaacgacgaactgcgagtccctagggaggagagaagaagattccgggccgttctgcacaattgtcgccaacatggggtaaagagccaggcgaaggggcacaaaaggtttaaggaatacctccgtggctttgcaagctacgtgcacatggtacagcccgaggaaggcgctgaactgctccgccaggtggacgagctgttgggtgccgaagggcagagttga

SEQ ID NO: 13906 - RNA, 1428 nt, unidentified
  source 1..1428: mol_type = other RNA; note = synthetic construct
atggccgatagtcccgtgctgtccatccctacctggctgctgcgcccactgcctatcaacagcaaacgcgatagcaagttggagagtcaaatagaaaagctggccaaaaacctgccggggtcacttgctcagttgacaacagagctttctaaggtcaaaatgttccgggaatacgattctgccgccaatctggcttctcgccatgtgtgggtcagtaggtaccattttttaaactcatctcttgacgaagaccggaaagcgcttttggagtttgcacagctgcacatgacacccacggctaaagcccggataattcgtaggctctccaaggatccccagatgggggtgagacgtgcggtccataggatcatccagaaggccccaccttacgaggtggctctacctgaggcacgagacggtaattgggatgcaagtggatggaccagaggagttcaaccaggcagattaatgcgcgtgcgccgaggacaaaagaagactcagaaagagtgggggctccccgggctatccaccgtaaagcaactgagaactctgctgggcatcaagtccgagaaacagctggggtacctgcttttagcgaccgacgaaggcgggggcccttatacaagattcagcattcagaaaaggaatggctccgacagggagatctgcgctcccaaaccccagctgctgtgggtgcaacggaagattctgcacgagatattagacaaggttcccttgcatgaatctgcccatggcttcgtgcgcggacgtagcactgtgaccaacgcgacaccgcaccgaggtgcagcctttgttctgaagtttgatctcgagaacttcttccctaccgtccactattacagggttatgggcctatttgctaatctcggttattccatgggaaacggacgcttcgaggctcgggataagagccgacagatcgcccctgtgctggcaaggctctgtgtctttgttgaagaccccaatgcatgggggactggtttcatgccacagggcgctccgacttcgccagctattagtaacctggtgtgtcgcgggatggacgctcgacttgccggcttggcagaacaggtaggcggagtctacacacggtatgccgacgacctcactttctcttttccagaaaccagccctgtgaatgttggccgcttcaggtggtgggtggaccagatttgccaccaggagggattctttttgaatcagagcaagtttcgggtgatcaggcggtcccagagacaaacggtgaccggaattgtagtaaatgatgagctcagagtcccaagacgtgaacggagaaggttcagggcaattcttcacaactgcaaagcccagggggtggaatcacaggcccgaggtaaccccgcctttagagattatctccggggcttcgcctcatacctcaactga

SEQ ID NO: 13907 - RNA, 1521 nt, unidentified
  source 1..1521: mol_type = other RNA; note = synthetic construct
atgactgatactcccacctggctgttacatgctttgccagccaatgccgtcgtggacgagaagctaaatgctacgttatcagctctggccgccgcattggccgacaatagagataagccactagttaccgctggcctgttgacagagatccagggccaccttgctcacgcccaaccgttcgcggcatatgaggccgctgtgaacgggatcgctggtcaggtgtggcagctgtttgaagctgtgcatcagaggcaaaatcgcccggctaaactcgcctttctgaatctggtggtgaggcatctcactccaggggcgctcgcccaattgtgccgtcgttgggccaaggacgcagaccctgcaattcgcagagctgtaggccgcgtgattgagacaggggccattcacgaggtcgcccttcctgcgaccaaagacggagcctggagccctgccggttggagaaaaggcacggtcgaggtcgacctttccagacacaaggtcggtacagccgtgcaagaagcgaattccgtgcccccactggcaaaccttagacagcttcgcgaactgctcggcatacgtagtgcaaagcagttgggctacttcctgctggcctctgacaaagatgacgggccctacacacggtttacggtgccaaaacggggtggcggagaacgggtcatttgtgcacctaagcctcagctgaaatgggtgcagcgccgaatacacgagcggatcctgtctggggttcctctggccgatgcagcgcatggatttgttcccggacgttctatcgtgagtaacgcggcagctcacgttggtgcagcagtcgtggtgaagtttgatctgaaggacttcttcccgaccatacacagctacaggatgattggcctattcgcccgcatgggctactcagtaggcactgcaaagattgctaccgctgatgaatcagcaagtgtggcccccgttctcgcacggctgtgttcctacactcctgatccccgagcctggggaaaagcccatgctccccaaggggccccaacatcgccagctgtctccaacctcatctgcaggcacctggatgctaggctcgggggactggctaggaaactggggggggtgtatacccggtatgccgacgatttaactttcagcttcgcggccacaggaatcgatttggggagatttcgctggtgggtcgatcaagtttgccagcaggagggattcgttatgaacgccgataagtttagggtgatcaggcggagccagagacagctagtcacaggcctggtggtgaacgacggcgtacgaccaaccagggaacagcgccgagcattcagagctgtgctccataactgtcggagaaatggcgtcgtaaccgaagcccgaggtgaccccaggttttctcagtatttacgggggttcgcatcctacctccacatggtgagaagcaccgagggagctgacctggttcgccaggtagccgagctccttgaccctcctggcggtggagaagacaagccctga

SEQ ID NO: 13908 - RNA, 1566 nt, unidentified
  source 1..1566: mol_type = other RNA; note = synthetic construct
atgagggaagatacacagagcacgtcaagtgtggtccttcacgaggcagagcttaagaataagcttcctattggggccacattcgacagcgcactgctcgagcagatatccaccctggccgatcagctccccgacagtatgtcagaactttataaggtgttatccgacatcgacatgctggtggagtttgatgctgccagagtatttgttgtgagactagtgctggcgaggttgcgagtactgacccacgctgaggagaaacaaagactggctctgctggatatggccagggattacatgactacagatgaatgtgtacccgtttgtaggagattcgcaaaggacccatcagcccatgtgaggggaagagtcaagactctgattcgaacgaaaaaacctaaagatgtggctttgcctctcgaggagggagaaagatgggatgcctccggctggtccaagggcatcaatgctgatcccgaacaagaaacatcccctctgttcaagcacgaacgcggctctcggattcagcgcaaacatggagttcccgaaatcgagactgtcaaggacttaaggactctcctgaagattaagtcagaaaagcagttgggctatctcctattgtccaatgagcttgaagacggcagtgggccctacaccctatttgagatcccaaagaaggacaaatcgcccagactgatctgtgcaccgcggcagcctctgaaaggaatacagcgtcgcattctggataggatcctcagcggagtgccgccacacgaaaccgcacatggatttgtgccaggtcgctccatcgtgaccaacgcggccgtgcaccagagcaaggagattgtcatcaaattcgacctcgagaacttcttcccatctatgcattactatagagttatgggcttgttcgctcaactggggtacgacgtgggagagggcttttttcagagcgacgacgagagtgaagctatcgcaccggttcttgcaagactgacaacctataccagcaatcctaaggagtggggccggggatatcttcctcaaggcgcgcctacatctccctacatagccaatctaatctgccgaggactggacgcacggctgtctgggttggcccgttcactggatggggactatactcgttacgccgacgacatgaccttttcttttgccgagctgccccgcacaaaaatcggtaggttccggtggtgggtggaccaaatctgccagcaggaagggttcgccgtaaaccagaagaaatttcgggtcgtgaggcggagccagagacagatggtgacgggcattgttgtgaacgatactctccgggtcccacgaaaggaacgacggcgctttagggccattttacataattgcgagcgctatgggctcgagagtcaggctcgtggccgcaaggatttcccagcttacctgcagggttacgcgtcttacattaacatggtccaccctgatgaggggcggaaattcattgagcaggtcgaacacatcttgcaattagatcgcgagggtaaactcccaatagagaaagaccccgaaaacggttga

SEQ ID NO: 13909 - RNA, 1470 nt, unidentified
  source 1..1470: mol_type = other RNA; note = synthetic construct
atggcagccactaaatcatccatccctgcatgggcctaccgaccgctcccattgaatgcccagcccgccacagaacttattcaacagttagacaagctcgagcagggcctgccaggaagttcttgggagatcctgagactggtgggcgagcaggatggttctgcaacctacgaagctgtggccaatcgcgctatggagattatctggacgcaccttgacgagtgtattgcaaacgaccctcacaccgtacggcagtttgcggcttctcatctccctattagggtcaggaaccgcgttcttcggagactggctattcacccctccttcagcacccgccgatcggtcaggtatcagattaacgagtccgccgtccgcgaagtggctcttcccagtgcccccgatggagagtggaatgccgagggttggttactgaattccaacagcagcactctgatgcgacctagaaagttgaaagctcccgacccaagactgccgaaactgaagaacgttaaagctgtcatgaaggagttgggcatcgtttcaaatcggcagctagggtggatgctccttgcaaccgacgaggacggagggccctaccacacctttgaaatcgggaagcggaatggcaaggctagaaaaatctgcgcaccatgctggcaactcaggcgggtgcaacagaggattctgcacaatatactggaccatttgccaccccatccggcagcccacggatttgtgaagggcaggtcagtggttaccaatgcggccccacatctcggaaaacccttgctactgaagttcgacctgcttgatttcttcccgacaatacattaccaccgtgtgatcgggctgttcgcctccatgggttacggtatgacttctcctttctttgatactgagaatcgcagccgtaacgtcgcgccagtgctcgctaggctttgtacatataccgaggatcctcgggtgttccgagatggaacgctgccacagggagcccctacatcccctgccatcagtaacctgatatgtcgacgcctcgatgcaaggctggacggcctggcacgaaaacatggggccgcctacactcggtatgccgatgacctgacattcagttttgaccaagatgagatttcagtgggccgttttcggtggtgggttgatcagatctgccatcaggaagggtttctggtacaccaggcgaagtttagggccatacgtagctcgcagcggcagagcgtaacaggcgtcgtcgtgaacgaacgcatgagggtgccacgcgatctgcgcagacggttcagagcaatcttgcacaactgcagaaaaagaggcgtagctgctgaagctaggggcgacgccgggttccctagctacttactcggcatggcgtcttatatgtatatggtgaaccccgacgaaggtgggcccgtgctagacgaagttagaaagctcttagcagaacaaggaaactga

SEQ ID NO: 13910 - RNA, 1488 nt, unidentified
  source 1..1488: mol_type = other RNA; note = synthetic construct
atggccagccatcgggacaggtatgatgaccgtccgccacttcctgtcggcgctgaaaccaacccagaagatctcgcccgcgttgctgagttagcggcgcgactcccaggctctgtgtctgcactgtcagacttcctacaggcgagggactcttacaacgattttgatcctacccgcttagcagccaacgacgcaatccttgcccgcctgggagccttccatctagccgctgaagggacccaccggcagctgctaaattacgcgcaggcctatatggcccctagcgaggtgatggcagtgtgtcgcatggtgttacgcgggggctctacacgcctgagagaacggtgtgttgatctgctcaggggggcacagcctgatggacttacactcccggctagacaagggggtgcttgggattggactggtctgctgcggggagtagagcggggcagactttttgccaaacagcccagccagagactgttggagagaaatggactgccccagcttaccacggtaggggagctgcgggccatgctgaagctgtcctcccccgagctgctggggtacttgttattatccacaagcggttcaggcggcccatatgcaacctttacaagacctaaaagatccggcggagagagactcatatgcgctcccaacccaaccctgaagcaggctcagagagccgtgttggagaacatccttgccagggtgcccgtgcacgatgcagctcacggatttgttgaaggacgctcgaccgtgacgaatgcccgcgcacaccttggcagggagctcttgattaaattcgacctccggaacttcttccctagcatcacttactaccgcgtcatgggactctttgcccacctcggctattacttggagggcggagtcttctcttcccgggacagcagtagggcagtagctcccacccttgccaggctgacgacctatacaccacccggcgctacttggcgtgcgtcttatactcctcagggggcaccaaccagtcctatcatttcaaatctgatctgtaggagactggacgctcggttgtacggcttggccgcacgaataggtgccacatacactcgttacgctgacgatctgacatttagtatgaatgccctgcccgaatcgggtctgggcaggtttcgttggtgggtggaccagatttgcgttcaggaggggttctttattaatcattcaaagttccgggttatccgcaagcatcagcggcaacaagtgaccggaatcgtcgtcaatgaagctctccgagtccccagggaggaaaggagaaggttccgggccattctccacaactgccgaacacagggtgtggaaagccaagccagagggcgagccggtttccgtgagtggctgctggggtatgcaagttacatgaatatggtcaacccaactcgaggagggcaggcgctggctgaagtgcaagctctcctagccgcagagggcccgtccacttga

SEQ ID NO: 13911 - RNA, 1422 nt, unidentified
  source 1..1422: mol_type = other RNA; note = synthetic construct
atgcacgacgaggtgcttctgggacgggttcgatctctggtggcggccttacccggcagcttgtccgaactgggtgcttgtttagcggaggtcgaaagttttgccgagttcgatagcgccgctgtgttggccgctcaggcttttgatgcccggcttgacgatctactgcgccggcctccgaaggggctctttgaattcatgcggagcaacctccctgtggatcagcagctgcaagtctgcaggcgcctagtgaagcatcccaatctgcctactaggaggagggccgttactctcttgaagcgcttaagaccagatgatgtcgctctccccctttcagcaaaaggcgaatggaactggcgaggctggactaggggaacagagcctggacgactgttcaagcacagaagaggagtgaaacgccaggccgaagtaggtgtgcctcaattgaaagacttagaggccctacggaggcgactcgccatcgactcgctgaaacagcttgggtggtttatgacagccaccgccggagagggagcaccatactgctcttttgaaatccccaaacggagcgggggtcttcggagaatagatgccccaaggggacagctgagggccctccaacgaacggtgctgcatgagatcctcagcaaagtggcagtacacgaggctgcacacgggtttgtgcccggtaggtccacattgaccaatgccgctccccatttgggccggaagctcgttctgaagttcgatctgagaaacttcttcccgaccatttcctactggcgcgtcgtggggttactggcctcactggggtacgatgtggggacgggcctgaacgtagtcgaggacagcagtcgggcagttgcaccagtgctggcgaggctcctgacatttcgcgacgacgctaagttgttcggcgcaggctatgctccacaaggggcacctacttccccggcaatatccaacctggtgtgcagaggcctggacggccgtctgtcagggttggcagcgagaatcggaggtacctatacccgatacgctgacgaccttaccttcagtatggatgctgaaccagccggcggactaggccgcttcagatggtgggtggacggaatttgtcagcaggagggcttcctccttaaccgtgagaagtttagggtgctgcgggcctctagacgccagcagatcacaggaattgtcgtcaatgactcacttagagttccacgggaggtccgccgtaaagttcgtgccatggttcataattgtcagaaaaatggtgtcgaagctgagtctaagggggaccccggcttcgtagacaggctcagaggcctggcagcttatattcacatggtgcaccccgaagaaggtcgccctctgctggatgcgatcaagctctttggggaaggcggcgaggatgactga

SEQ ID NO: 13912 - RNA, 1275 nt, unidentified
  source 1..1275: mol_type = other RNA; note = synthetic construct
atgctcgacaaactgttgccttatctgcagattttcatcccactctcagttattctgttgttcattgcacagttcctcgaaaagcgtaaaaacgagacaagacaggctgccccaccccgaagaataggagagcggtctgcctcttcccgcaggcctacacgaagttttcctcctgccccggtgaatgccggcgtaaatactacaaacccaaggtgtcctaataagaggcatgcttacatcagagcgccacgcagaccccaaagtgatccatcagccgctgcccgattcgggatcccagcgttgatgaaccggggagacgtcgccaagtggctgggcatgagctggaaacacctcgtatggctctgcaacctctttcacaattgggatcgaaaaggagttgggcactatcacgcctggaaagtgcccaagagagccgggggcgaacgcgttatcactgctcccaaaccctacttgcgggctgtgcagaggaagattctggcagatattctatccagaatccccattgagcctcaggcgcatggttttgctcgcaaccggtcaaccgtcaccaatgcatctgtgcatatccagcggcccatagtagtgaaattggacctcgtcgacttctttccaaccatcacctaccgcagagtccggggggtgtttggcacactgggttatagcgaggaagtgtcgggcgtcctagctcggctttgcacgatcgccccaactgatatgctgcccctcgctaatgacctgcgtcgaagcctgctattacgacggcgccatttacctcaaggcgcacccaccagtcccgccttatccaatctggtttgcagaaggatggaccgtaggcttgccggcttgtgtgcaaagtttaacgcagtgtacacaaggtatgctgacgatctgacatttagcggagatgagaagttcgctgccgccctgggtgatttctttgacattgcttgtaggatcatcgcgctggaagggttccggataaattgggccaaacgccgcataatgcggaagggagccagacaactggtgaccggcgtggtcgtgaaccgcagaacgactcttcctcggggcgaacgcaggcaccttcgtgctcttctccatcactggaggaccaagggggacttcactgcgccgccacacgtggagaacaaagttgcatggctgggaggtaagctggcatacttttccatgattgatcctgcaaagggagcaccgatgcttgcccagttcaaggctctggccagggggagatga

SEQ ID NO: 13913 - RNA, 1308 nt, unidentified
  source 1..1308: mol_type = other RNA; note = synthetic construct
atgtttcagtggtcttttcgacccctgaaatatagtgctcaagagtccgatgtgaaacctagtcctccgcccgcctctcgaatacccgattccaggttccagatcacggattgtagactgagatcaggcgagtcaagtgcggtgaacgcgttctggattattggggcgcttatcgccgcatggctggtgttgcggtggctgacaggacgcggaaccgctaggcctgctggagatcccttcgtgacaaaacgcaacccaaagaccggtgaaccggtaccaccaggcagcggcaaaggacgggaacggcttcgagccaccgctactcacaggccgcagctcctggcagaaaatggtcttcccaatattgcccgccgtgatgacttggcacgcgctctgggtattactcggggcacactggactggctggcattccccgacgacagggagcagcctcctcactactccgcatttgccgtgcctaaaagatctgggggttacagggtcctatacgcccccaaaccgaagctcaaggccgcccaacactggatcagaaaggaaattctctcaaagacctttgctgaggaccccgcacatggcttcgttgccggacgcagcattcataccaatgcacagccacatgccgggaaagacatcgtggttacactggacctggataactttttccctagcgtgacctacagacgggttcgcggcatcttccaaagcctgggctatggggaggaggtagccatccccctcgccatgctgtgcactgttaagccagccgaaaaggtgcgcgaattcgtcggcggtcagaggcaccgcatgttaccacagggggccccaactagcccagcacttgctaacctagcttgcaggcacttagatctccgtttggcaggactggctaaaaagttcggctgtacctacacgcgttatgctgatgatctgaccttttctggcgacgacactttcagacggtcgttgaaacgatttttaaagctcctccaccagataatcgccaaggagggatttaaactcaaaaaggggaagacacactttgctcggaggggagcgagacaggaggtcactggcctggtggtgaacgacgggcccagagtccctcgagcctatcgacggaggctcagggcaatcctacataacgctagacgcggggggcttgaggcccaaaatcgggagaagcatcctcactttcgtcaggcactgaggggcagaatagaattcgtccggtccacacatccagacttggccgagaagctgattgccgaattgaatgcgatcggatga

SEQ ID NO: 13914 - RNA, 1167 nt, unidentified
  source 1..1167: mol_type = other RNA; note = synthetic construct
atgagtgtgttctggatcgtggtggccctcatcgcagcatggattgttctgcgagcccttaccggcaggagaaccgcacgggttgtgggtgacccgtttgtgcggatgaggaacccaaagaccggggagccaattcctcccggtagcggaaagggtcgaatgcgcttaagggccaccgctgctcaccgacccgaattgctggctgagaacggcctacctaatctagcttcaagagaagagctcgccgctgctttggggatcccaagaggaacactggactggctggccttgcctgaaaggaagaaagaacctcctcattacactgcctttgcagtgccaaagcggtcaggcggctatcgcgtgctgtacgcccctaaggctaaactgaaagcagcccaacactggataaggcgggagatactggcaaagacattcgcggaggatccggcccatggtttcattgccggccgcagcatccacacaaatgccgccccccatacagggaaagacattgtcgtcacccttgatctcgacaactttttcccgtccgtgacctacagacgggtcagagggatcttccagtctctgggttacggcgaggaagtggcaattcccctcgctatgctgtgcaccgtcaaacctgcggcgaaggtacgggagttcgttggggggcagagacaccgcatgcttccccagggagcgcctactagtcccgcactcgcgaatttggcttgtcggcatctggatctgaggctggcaggcctagctgccaagttcggatgcacatatactaggtatgctgatgacctcacgttttccggagatgccgcattcgagcgctctctgaagcgctttttaccattgctccaaaagatcgtgaaagccgagggctttaagctcaaaaaagacaagactcacctcgccagacgtggagcccgtcagaaggtcacgggcctggtggtaaatgatggccccagggttccacgggcatatagacgaaggctgcgtgctatcttacacaacgctcggaaaactggacttgacgcccagaaccgagacaagcacccccattttgctcatgccctgcgcggaagaatagaattcgtaagaagcacacacccacagttggcagccaaacttcttgccgaactgcgctccctggggtga

SEQ ID NO: 13915 - RNA, 1110 nt, unidentified
  source 1..1110: mol_type = other RNA; note = synthetic construct
atgaccgaacgacgggccgcgatggggttcttcgattggctcactaggcgcttactgggaagagggaagccagcagcccctccagaggaaagactgggtcggaagcgtcttcgtgctaccgccgctcacaggcctgatctactggctcagaacgggctcccgtccttggcatccagggacgacttggctgccgcactcgggatctctaggggagtcctggactggctagcctttccagagcgcaaagaagaacccccacactatgtggcttttgccgtgcctaaacgcagcggaggatatagggtgttgtatgcccccaaggccaaactcaaggccgcgcagcaatggatccgacgcgagatactggctaagaccttcgcggaggatcccgcccacggtttcgtagcagggagatcaattcatacaaacgcccagcctcacgcgggtaaagacatcgtgattacacttgatctccaggattttttccccagtatcacataccggagggtccgaggcattttccagtcgttagggtacggagaagaagtggcgatcccactggcaatgctgtgcaccgtcaagcctgctgagaaagttcgcgagttcataggcggccagcggcatcggatgctccctcaaggcgcacccacatcacctgcccttgctaacctcgcctgtcggcatctagatgttagactggccggactggccgctaaatttggctgcgcttatactcgctacgccgacgacctggcttttagcggagacgcaacgttcgaacgaacccttaaacggtttctgccgctcctgcatcagatcgtcaaagccgagggctttaagctgaaaaaggggaagactcatctggccagacggggcgcaaggcaagaggtgacgggtttggtagtgaacgacggccccagagttccgagagcataccgacgccagctgcgggcaattcttcacaatgctagaaagaatggcctggaggctcagaatagggagaagcatccacactttgcccacgccttgcgtggccgcattgagttcgtgagatctactcacccccaactggccgcgaggcttctcgcagaattgaaggcattagcttga

SEQ ID NO: 13916 - RNA, 1110 nt, unidentified
  source 1..1110: mol_type = other RNA; note = synthetic construct
atgggtttctttgactggctgactcgccgactgctaggagcaggacgtcccacccccaacaggccagagtgggcagaagtgagtgaggaggccggacgctctaagaggcttagagccacggcagctcatcgaccgcaactgctagcacagaatggccttcctcccctggccactagagacgacctcgctcgtgccttaggcatctcacgaggggctctggattggctcgctttccctgataaggccaaagagccgcctcactacagtgcctttgcggttcccaagcgcagcggtgggtatcgggtgttgtacgctcctaaagggagacttaagaaggcccagcagtgggtctaccgtgagatcctggctaaggtaaaaccttccgccgccgcccatgggtttgcaaaaggccgaagcattcacaccaacgccgccccccacgcaggaaaggatattgtgatcacccttgacctccagcacttcttcccaactatcacttatcggagggtgagggggatcttccagtccctcggctatggcgaggaggtggcaatagccttggccatgctgtgcaccgttagaccagcagagaaactccggggcttgttggggggacagcgacatcggatgctgccccaaggcgctccaacttcaccagctctggcaaatttggcttgcaggcacctggatgctcgcctggctggtctggcacgtaagtttgggtgtacgtacacacggtacgcggacgacctcacattctctggagatgccgcgtttgaacgcaccctcaagagatttctgcctcttctgcatcaggtggtaaagaaagaaggattcgaactgcaaaaaggaaagacacatttcgcgagacggggcgcacgccaggaagttacaggtttagtcgtcaatgatggccctcgggtcccaagggcatatcggaggcgcctcagggccatactgcacaacgcccgcaagacaggccttgaggcccaaaacagagacaagcatccccactttgcccacgcgttaagaggtcggattgaattcattaggagcacccacccgcagctggccgtgaaactgctcgctgaactaaaagctttgagatga

SEQ ID NO: 13917 - RNA, 1113 nt, unidentified
  source 1..1113: mol_type = other RNA; note = synthetic construct
atggggttccttgactggctcgcaggcctgtttggtggaggacctaccgagagcggtggacgctcgtggggagtgtttgagccaccacctccacgcgagcggaggaaaaagctgcgagcaactgcgcaccatgatcctgatcgcctagccgcccaagacttaccatccctgagggactgcgcagaactggcaggcttcctcggaatttccccgaatacactccgttggctgacccacgttgacgaaggggatgagcccgagcattatgttgcctttgcggtgccgaagcgctcaggggactatcgggtattgtatgctccaaaagctaagctgaaacaggctcaacgccgggtctatgatgctatcctgagtcgagtaccccttcccgacgcagcacacggctttgtgcccaagcggtctatcctcaccaatgccgaaccccacgcagaacagtacgtcgtgatgaacgtggacctgcaggacttcttccctagtataacgtacagaagagtgagaggcattttccaggctttaggatacggcgaggaggccgctatccctctcgccttgctttgtaccgtgaaacccgctgggaagctactggaatatatggggcatgttaggcataggcagctgccacagggagcccccacttctcctgccctggctaacttggcctgccgtcgactggatgcacgcttgggtggacttgcccgcgcatttggggcgacctacactcgttacgcggacgatttaacattcagcggcgatgacgctttcagcgacgctctgggtcgttttgtgaggcacgctcggacaattatcgccgatgaagggttccgggttaatgccagaaaggtccatatcgccagaaaaggcaggcggcaacaggtgaccggcttggtggtcaacgatgctccgtccgtcccccgaagatacagacgggagctccgagccattctacacaatgcccgcacaactggcctggatgcacagaacagacacaaccacccagacttcgccaggcacctgaggggcaggatagcgtttgtaagaacaactcatcctggtcttgccgatcagctccaacggacgctcgactcactgctgtga

SEQ ID NO: 13918 - RNA, 1068 nt, unidentified
  source 1..1068: mol_type = other RNA; note = synthetic construct
atgcagactatactgtggctcctcattctgctggcatttctcaaggtggtttccaacatcaagcagcgtatccgcatctttctgaatggagacttcaaccgactgcataaactcgggttgccccagatagaggatttctcacagctggccaactttctgaaaattagcgagacagaacttaactggctcatcgacaagtccagcgccaatccccaaacgggcatttcaagacactatgtgctaaaagagatcagtaagaagaacgggaaaaaaagacttctgcatatcccaaaggctaaactgaaagaagtacagtggataatcctcgataagatcctgaatttgctgtcgtatcacccagcagcgcatgctttttgtttccggaagtcaatcgtgactaacgcagaaaatcacctcggtaaggccattgtgattagggccgatctgaaggacttcttccatactattagaacacaccgcgtgcgcgccattttccggaggttgggctactcttacaaagtagcatacagtctggcgctcttatgcacatccaggttacccaacagccagaaaagagctttgccacaaggtgctcctacgtcccccgccatatctaacctgatcgcatttagccttgatcggagattgacaggactggcccttaagttaggcttcacctacacccgctatgctgacgatctgatcttcagcgggaaccgcaaaatcgtgaaagcccttctgaagaacctaaagaagatagtttccagtgagagatttatcttgaacaaagagaaactcctgatcgccagggctgaacgacggcaaaaggttaccggaattactgtcaatcaaaagctttctattcctaggaatgagaggaagaagatgcgagccattttacacaattccctgaagaccggccttgaaaaacagaacctgattcagcatcctaatttcaaagagcacctccggggcaaactgtcttttttcaagatggtcaatcctgaccaggctcgtccgttgatcgagtcatttaataagaccgtcaaaaaggaactagcgagctga

SEQ ID NO: 13919 - RNA, 984 nt, unidentified
  source 1..984: mol_type = other RNA; note = synthetic construct
atggccgcctggctcgcaattacccccgcgaaactgaggtggcttgcctggcccagatcccatgctccccatggagtccgcaagaggtacttcggaccccctgatcctgttcaacactactatgaggcagtgagaatcaaaccggacggcaggaagaggtacctggggtgccccaagcgggagctcaaagaagttcagcgtaaaatacttcgtgggatcctcgaaaagctgccgcctccaccacgcgcacatgcctattgcagaggcaggtcgtccctaaccaatgctagagaacacgtgggccacgcagtggtggtccacttggacttgagccatttctttaattcaatcaacgttaggcgggttgtggggctcttcgcggctttagggtaccccaggcctgtggccgtgactttaggcctactgtgcacataccaagtccacccagaagtaggctgggagttctttaacagataccgcagagtagtacaccgagggttgccccagggtgctccgacaagcccagctctgagtaaccttatctgtcagcggcttgataggagactgtcaggtttagcccggcggtttcacgcccggtatacgagatacgccgacgatctgactttctccggtaaccgggacttcgctaagggactcgagaattttctcaagatggccagacgaattatcgccgaagagcggtttgtgttgagcgagcgcaagctgcgaatagcgcgcaaagggtctaggcagtgtgtcaccggtattgtggtgaacgatcagccaggggtcggacgtacacaacgaagacgcctgcgcgcaattctgcatcactgtggccggggacgccctgaagagcagaatcgaggcaaggaggaaaattttcgcggatatctgcaaggctgggtcagttatgttggaatggtgaacccagctcagggccagaaactgcagtctgcactggagagggtgcgttggccttga

SEQ ID NO: 13920 - RNA, 1203 nt, unidentified
  source 1..1203: mol_type = other RNA; note = synthetic construct
atggtgaaatatagatcccccccttttttctacgaagggaacgtgggtttcttgaagtggttaaagaacgtacttttcggcgggggcgaggaagagaggttcaagagcttcgagaaggagatttacatcgagcgcgtgagctataggggggccggcaaaaaagaagtgtcgcgaccgagaagaaacgtacgtgcaagcgagaagattcctcccggaggggaccgtaagctgctaaacgagctgggtatccctattctcgccggtaatcccgacatagctaggcgactcggagtgtctaccggggagttgtgttggctggcattcccaaagcggtttgacaccgtggatcactatagggagttccatatcccaaagttaaatggcggtgaacggcggattctggctcccaagaagaagctgaaggccgcccagagatggatccttaagaatatcctgactgccgagcgcgtcagaggcctcgttcatgaaaacgtccacggtttcaggagagggaagtctgttgctacaaatgcccgtccacacgtgggggcagaagtggtggtgcatctcgacctgactgattttttcgaaaccattactctgccgcgtgtcagaggcatctttcggaagctgggatacagtcacgtggccgcaacaacccttgctatcctctgtacggtctacattggacgggtcgacgaaactaaaaccggctcccgcaaacaggtgttgcctcaaggagcacccacttcccccgcgattaccaacctggtgtgcaataaactggataggagactggctgggcttgccagaaggtacggagtcaaatatacacgatacgctgatgatatcacattttcaggcggaaaatctttttgcaatgcgctccgccggtttctccctaccgtacggcgcatcattagggaggagcgatttacgatcaacgaaaaaaaagtacacgttgcgaggaagggcgcccggcagtcagttacaggcatagttgtcaatcaacagatgaacattccccgcagcgaacgaagacggtacagggctatactgcatcagctacgcaaaatcccacctggcacagagaagccaaaaaaattaaacgcacacctgtccggagtggccgcttatttgtcaatgataaatccagaagccggtcgcaaaatgcatgaggaggtgaagagtgttttcaactga

SEQ ID NO: 13921 - RNA, 1044 nt, unidentified
  source 1..1044: mol_type = other RNA; note = synthetic construct
atgggcctcatctcggacttttttaagaatctgtttgggagccctgtcgaaaataaaggaggtgaaaatgagccaacacagaaatccgcgggtaatgactccggaccatctgagctcaccagattagaaatgaataggcttcctcttatagccggacgggcggaattgcttcaagaacttcaaatcagcgataaggaactcgattggtttgtgaaacatcctgagtggcactacactgtagttagcattcccaagaaatcagggggagcacggaccatttacgcacctaaaaagaggatgaaaagaatccagcggtggatcctgagtgagattctgagcaaagcccgtgtcgagggatctgcccacggcttcgcaaagggcaggtctatcactactaatgctttcccacacacgggcacggagatcatagtcaacatagacctggagaacttcttcgactccgtgaagctctggagagtgtactgcgccttccggaactttgggtatagtggcgagctgtcttccattttcgcacgattgtgctgcgtgaaaggagctttaagacaaggcctgcccactagccccgccctgacaaacgttgtgtgtgctatgttagatcgtcgcctgaatgggctggctgtaaagttcggctgtacatatacccgatatgccgacgacatgaccttctcaggcgatttgaaattcaaggcttctctgtcccggtttatcccgatcctgaagaagatcattcgcggtgagaaatttaagattaacaggagcaagatgagaatcacccgaaaggggagtcagcagaaagtcaccggtctagtcgttaacgaaaaggtgaacatcccacgcgagaaaatgagactctggcgcgccattattcataattgtcgcataaaggggctcgagtcccagaaccgggataagcacaaacatttcgcagcgcacttgaaaggcctggtgtcatttgctgcccaggtggcccccgccaagtcagaaaggatgagggaggaactaagtcaggtgacaaagccgtga

SEQ ID NO: 13922 - RNA, 1047 nt, unidentified
  source 1..1047: mol_type = other RNA; note = synthetic construct
atggggttctttgacttcctgaaggacctgtttaacccagtaaaaggaggtacaggtggccccaaaccagccggcaacagtccggctagagcactcgcaccccgcaagacatatgctagcccaggagggcctagacctctggcaccaggtctgccccagcttcctactcctgccagcctggccgctttgcttaggatcgcccctgaaaagctggcttggcttgcgaaagagaagggccgtcattacgctacatggaaaataccaaaagctaaggggcatcggaccattgaggcacccaagaagcagctcagagccgcacagagagcaattcacagagagattctctcaaaagtcgcccccaacgctgcagcccacggattctgcacaggacgctcgccgaggacgaatgcggaaccgcacgtgtttcgaaaactcgttgtgaagctggatctgcgcgatttcttctggcaagtcaaacggaatcgagtggctggacagttcagagcgctagggtttcctcccgatgttgccgcgatactgtggcggatttgttgccatcgaggaaggttaccccagggggcacccacttctcctgccttgacaaatatcgtgtgtaggcgtctggacgcacgtttgtctggccttgctaagaagtacaaagcccgctatactaggtacgccgatgacttgaccttctccttcgatgcccccaatctggccgtgcaggaaccactacgcgccatccggaccatcctttccgaggagggctttagtttagcacgggagaagactcggtttctccgccggatgtccaggcaaacggtgaccggcatcaccgtaaactccaagttaagcccaagccgggaggaagttcgatcactgagggccctgctccacgaggctagaaccaaaggccctaaggtggcgaaccgcaatcaggaggaagcctttggcgccagggtcaggggtcgaatcgaagcagtgcgcgctattgacaagtctaaaggggaaaagctcctggccgactatagaagagtcgcttggtga

SEQ ID NO: 13923 - RNA, 1023 nt, unidentified
  source 1..1023: mol_type = other RNA; note = synthetic construct
atgggtctgttcgactttctgaaagatctattcaaccccgtcaaaggacctccacctggcaagggaggcccaccagtctctagaccagggtctggagggcgaccggttagacccttggctgcgggtttaccacccgctagagatacaggcgagctggccgcaatcttgagaaccacgcccgagaaagtggcttggctggttcgcgagacaggacggcattacgctacttggcaggttcccaaagctcacggtcgtcggactatcgaggcacccaaaaagcaacttcgaggcgtgcaacgcgctatacacagagagatcctctcccgggtttcaccggcagaagcggcacacggctttagaaaggggaggtcgcctcgcaccaatgccagtccccacgttgccaaggaaatggtcattaagctggacctgcgcgacttcttctggcaggtgacgcggaacagagtggccggactctttcggagcctcgggtaccctgaagatgtagccctcgttttatggcgcctgtgctgccacaaagggaggttaccccagggggcacctacctcccctgccattacaaatctcgtctgtaggcggcttgatgctagactcgctgcagccattcgtagcatgaacggcgactatacacgctacgccgacgacctgactttttctttccgagaagccagactgcctatgccccgacttgccaggtttctgagacgcatcatttccgacgagggctttcgggtggcacctgaaaagacccggttcctccgtcgaagtagtcgccaggccgtgaccggcctgactgtgaacgccaagctgagcccaccgaggagggaggtacgagccctgagggctctattgcatgaagccaggttgaggggtccagaggcggcgaatcgggatcatctgaagggattctcagccgtggtgagggggagaatcgaggcagtcagggccatagatcgcgctaaaggcgaaaagcttcttgcagagtatcgtcgggtgagctggtga

SEQ ID NO: 13924 - RNA, 1029 nt, unidentified
  source 1..1029: mol_type = other RNA; note = synthetic construct
atgggcctgttcgacttcctgcgggacttgttcagacccgtgaaaagacctgcaccagatcctcctcctccagcgggtgccaaagccaaggggcctccaaataggggtgcttctccccctcccgcaggacttcccccaatcgaatcgctagccgtgttggctggacgcttaggtatccctcagaaggatctcgcttggctcatgaaaccccgagccaagcactatcacacacatgagatcccaaaagctgacggccgcgtgagaaaaatagagtccccgaagagtcggttgaaaaaggcccagcgttggattctgcgtgagatactagatagggttcctgctgcccccgcagcacatggctttgtgaaagggagaagccccgccactaacgctgcccctcatgctttcaaggccattgtggccaagctggacctgcgggatttcttttggcaggttaccctgcgtcgggctcgcggaatctttgaagccctcggttactcaggcgatgttgccaaggctctcgctcggctttcctgtcgcgacggcagacttccccaaggcgctccaactagcccggcactgaccaacctcgcatgccgaagactggataggcggctggaagctttggcgcgcgcctttggcgccagttacacacgatatgcagacgatattaccatctcacacaggacgggctgcgccccacttgacaggttgctggcgtggacgaagactattctgcgagaggaggggtttcacctcgcgccagagaagaccaggatcgtccggcgggggtctaggcagacagtaaccgggctcactgtgaatgcacgcgtaagcccgccaagaggaaccgtccgggcattaagggcgctgttacacgaagcaaagacaaaaggcgcggccgctgccaatagagacggactgccccacttcgcagcccatgtccgcggaagggtggaagccgtacgcgcagttgaccgagccaagggggagaaactgcttgctgcctggagatccgtcaactggtga

SEQ ID NO: 13925 - RNA, 1239 nt, unidentified
  source 1..1239: mol_type = other RNA; note = synthetic construct
atgagtctaaagcgctggttcggaaggtggctggccacagccgaacaccggttagaacggcaaagggccgagaagagaagggcaggccctcctccttggcggtatccagacccgttcaccggagagttgataactcccccagatgatggcgacagggacaggcttgcagcagctggcctgccagtactgtctacacttgaggatctcagccgagcaacagggttgtcctggcagaggctattgtggctcgctgccccttctagtgcctacgcaggcggatcgccacactacacattcttcaccgttcccaaagctcgcggggaaccccgcattatcctggccccaaaaccagcactgaagtcagttcagcgttggattctgagaaacatcctgaaccgcataccccttgccgaccccgtccatggctttcggagaggccatggcacgcgcactaacgccagagtacattgcgggaaggacgtggtcgcgacttttgatctggaggacttcttccacacagtcacctaccgacgagtgaggggtctgtttcggagccttgggtattccacagaactgagtgtcctgttgggtttgctgaccacgtttagacctgccgcattcccctatgactatatgagacacgtgcccaccctggtttggctcaaatcaatgtcaaccgctcggcgtagctggagagggcacccaactacccccccatttctgccccaaggggcccctacgtctccagcactgtccaatctcgtcgctcggcacctcgatcgaagactcgctggacttgccaggcgcttaggggctgcgtacactagatacgcagatgacctgacttttagcggccatgcggagtttaggcacggcttggcccggttcttacctcttgtgaagcgcatcgtgcgcgaggaagggttctacctggccaccggtaaacagaggattcggcggaaaggcggacgacaggtggtgaccggagtggtggtaaatagacgtaccaacgtgccgcgagagacatatagacacctcagggtcctgctccataaggccgcggttcatggtcctgagagcgtgcgcttagaaccggctgcccctactgatcctggagtcctccggccacatctggagggctgggttgcctgggtgtcccacctaaatcccgcccgtggtgctcgcctcagaaggacatttgaggctatcgcatggcccgctccgtctggagaagcgtga

SEQ ID NO: 13926 - RNA, 969 nt, unidentified
  source 1..969: mol_type = other RNA; note = synthetic construct
atgctggggatcacattacgcgaccttgcttggttagccagtgccgctcccctgtcaccaccacactacgtcctggctgtccggaagaagagaaatggcggcaagcggctcatcctcatgccaaagaagcgtattaaagctgttcagagagagatacacagacgcattctctctcgccacgcgccttctccctgggcacatggatttgccactggtaggtcaatcaggaccaacgcagccccacacgtcggaaaggaggtggtggcaaaatttgacctgcgcgaattcttccattccataacgttccctagagtacgaggtctgctacgtcagcttggctacgcacccgacgtcgctcgcaccattgccctgctgtgcacgttccatcctgggcgcatccgtgagaggatgaggcctggaggagtgagctacgctgatctcgccgcagcatttcgagccccggggagatatggtttcagacgaatcctaccacaaggcgctcccacttcccctgcactggccaatttggctgccagaggacttgatcgacggttagccgctttggcgaagaggttccgggcggattacacacggtatgccgacgatctcaccttttcgggtggcgcagaatttcaccgcgatctgccccggttcatccctctcctgaggagtatagtgagggacgaggggtattttctggcaagagagaaaactagagtaattcggcggggaaattgtcagagggtgaccgggcttgtggtgaacgagaaacccaacgttccaaggggcacctatcgggagctgaaggccatcctgcacaattgcgtgacaaaaggcccggaaagccagaaccgcgcgaaggtccgcgactttcgggctcatttggccggccgaattgccttcgtgaaatccgttcatctccgtcacgggatgcgattggaagaaacattcagcaggattagatggtga

SEQ ID NO: 13927 - RNA, 1209 nt, unidentified
  source 1..1209: mol_type = other RNA; note = synthetic construct
atggatgacggttatcagtttaagaataagcgcgtattcctggaaaatctgcgcaggatcaaccaaagggctggagtcgagcccgagatcatcgatctaattgaagttcgattctggggaaatcggatagaaatcaacgacaaagaactgcaggggttcttgcacaagaaccctcatcttgaccagagggtcttaaattttctggccagttactttttggagatgaaaaggcgcggacttagatgcattttcactccctcccacctggcccatcttctggagattagcctgaagcggcttcactggctagccgatgataagagatcccactatacatgtttcagcgtgaaaaagcgaggtggcggcgtacgcgaagtcttcgcacccaaacccaatctaaaggccgtgcagcggcagattttggatgacctgttacaccgggtgcgtctgaatagccacgccgagggctttcgaaagcgtcggagtattctgaccaacgccaagagacatgtgggaaagaaagtggtcataaagatggacgttaaggacttttttccaagcatcacctttgagagagtgctcggaatgtttgtgtctctcgggtatccacgccaagtggcagtcctgctcacgcgcctcgtgactcataatggcaagctccctataggggctccaacatccccggcgatcagcaacattgtctcacgacgcctggaccgaaggttcagtcggctcggtgaaaaagctgggttcgactactctagatacgcagatgacatcactatatcatctaacaacaaaggcgttaacaggatgatacccttctttaaagaaatcctgagagaggaagggtttgaagctaatgaggcgaaaatgaggatcttaagaagcggcgggaggcagaagatcaccggcattgttgtgaataagaagcctaacctggataagcatgagattaggaaactccgggccgtgatctacaattgcagtcacaaggatcttagacaggaggcaaaacgctgggcagaaaacgagaaaggtttgacaaacccatcatcttatggcttgcgggagttccggtcctccctgaaaggaaaagttaatttcgtgagaatggtaaacccggagacaggcaagcgtctgattgaggctctcgactacaaggggtcgtcattctttcaaacccctcctaaagccgaagtcatctga

SEQ ID NO: 13928 - RNA, 1221 nt, unidentified
  source 1..1221: mol_type = other RNA; note = synthetic construct
atggagcaaaaaatggatcatcgatacctctgcaacaacaaggagaagtttataaagaacctgaggctcttcaatcaacgcgtcgaggtcgaacctgagattgttgacctgatcgaggcttatgcccgattgagacttgaccagggcaaagaaattcggtactatggtaaccgcatttccagcaaaaacaaggaactgcaggaatttcttgacaagaataggcacttagatcataggattcttaatttcctggcgtcatatttcctcgagatgcaaaagagaagcttccgctgtgtatttacaagttctcacctggcacattttctcaagatcagtacaaaacggctcaactggcttgctaacgaccgtattaagcactacacctgttttaacatcaaaaagagagatgggaacaaaagagaaatcttcgctcccatgccctatctgaaaggcgtccagaggaagatcctggacgatctgttacagcgggttggcctgaattcgcacgccgagggattcaggaaaagacggtccattctaaccaacgcacggcgacatataggtaagaaggtggtgatcaaaatggacgtgaaagacttctttccatccatcacttttaaacggattttggggatgtttatcagcctgggataccctcggcaggtgtctctgctcttgaccaggctagtgacacacaacggcagattacccattggcgccccaacttcacctgccatcgccaatattgtctcaacccgcttggacaaaagattcagccgtctgggtgataagatgggatttgactatagccgctacgctgatgatataacagtatcttccgataaccgcggcatcaataagatgattccattcttcaaggagattatccgtgaagaggggtttgagatcaatgagacgaaaatgagggttcttagaaacgccgggaggcagaaaatcaccggcatagtcgtgaatgagaagccgaacatcgataagaaggaaatcaaaaaactgcgcgcagtgatatacaattgccaccacaaggacattaaacatgaagtgaaaaagtgggcgaagaaagagaagtccctgaataacccttcagactacactctcagtgaattcaagtctagcctcttgggaaagatcaatttcgtgaaaatggttaatcccaagataggaaatcgactactgaagcagctggggcagctgagtatttga

SEQ ID NO: 13929 - RNA, 1215 nt, unidentified
  source 1..1215: mol_type = other RNA; note = synthetic construct
atgtatgatcgacgactgtgcgagaataaggacgtgtttatcaacaacctcagagctacaaatgaacgagcagaggtagaacctgatattgtggaccttgttgaagcctacgcccgcctgaggctggatcaagacaacgagctgcgcttttacgacaacaagatatggattaatgacaaggagttagagcagttccttgataaaaatcggtacgtggatcatcgggtattaaacttcctagcctcctactttcttgaaatgaagaagaggggcttaaagtgtattttgaactcgtctcacttggctcacatcctcagggtccctcggaagaaggttaattggttggcaaatgaccgagccgaccactatgtgtgctttcacactaaaaaaagagatgggagcaagcgtgaaatcttcgctccaaagccttatattaaaaaggtgcagaggcaaattctggatgagctgctgcatcgcgtccgcctaaatttcagagctgaggggttccggaagaaacgtagcgtagttacgaatgcgcggcggcatatctctaaggaggtggtcataaaaatggacgtgagggattttttcccatctattaacttcaagagggtgctgggaatgtttgtgtctctcggttacccgcggcagacctccctgttgctgactcgcctggttactcacaacggcaggctgcctatcggcgcacccacatcacccgcaatcagtaatatcatttgtaggagaatggataagcgcttttccaagctcgggagaaaaatggaattcgaatactcacgatatgccgacgatatcaccatctcctccaacaataaaaagatcaccgggatgatccccttctttaaagagatcatgggcgaagagggcttcgtggtgaacgaggccaaaatgcggatcctcagaagtggaagcagacagaagattaccggagtcgtggttaataagaaaagtaacatagccagagaagaaatcaaaaaactacgtgcggtcatatataattgcggtcataaggacattaagcaggagatgattaaatgggccaggaatgagaaaaagctggcaaacccctacggatatacactcagccagtttaagctctcattgcttggtcgcataggattcgtcaaaatggtcaacccagggattggcaacaaactgctccaacagtttgacacacttagcctgaacgcttga

SEQ ID NO: 13930 - RNA, 1248 nt, unidentified
  source 1..1248: mol_type = other RNA; note = synthetic construct
aggcaaaaaatggcgggcggactgcactgcaaagacaaagagtctttcataaagcatctccgtatcataaaccagcgtgctggcgtggaaccagatatcatcgatctgatcgaagcttatgccggcctgcgccttaatcaggacgaggaagttagattctttgacaatgcagtgaatatcaagcacattaaggacaaagagattaaagagttcttcgacaagaaccggagacttgaccacaggatactaaacttcctggcctcttactttatagaaatgaagaagagaggtctgaagtgtatcctgaattccagccacctggtccacctcctcgagctctcgatcaacgagatcaattggcttgccaacgatgggaaaaaccactacagacattttacccgaaagaaaagggacggaggcacccgggatatttttactccccgcgctcgcttaaaagaggtacagcgacatattctggacgatttccttcatagggtcagactaaactcacatgcacaaggattccgtagaaagaggtccattattacaaatgcagcccggcacatcgacaagaatatcgtgattaaaatggacgcgaaagaattctttccctcaataacattccagcgcgtgtctgggatgttcgcgagtctgggttacccacggcaagtctctgtgttgcttaccaagttagtgacccacaggggaaggctcccgatcggagctccaacatcccctgcaatcagcaatatcgtttgccggcgcatggataaacgatttgccaggctgggggagaagatgggcttcgattacagtagatatgccgacgatttgacaattagctccaacaacaaaaagctgacgaagatgatccctttctttaaggaaattatgagagatgaagggtttgaggtgaaagaagctaagatgcggattctgcgaaacagtgggcgccagaaggttaccggtattgtggttaataagaagaggaatatcgagcgcaaagagataaaaaagttgcgcgccgtcatccataactgtaaacacaaagatatccgacaggaggccattacgtgggcaaagcgggagaaaaagctcgatgacccttatgcctatactctccgggagtttaagagctcactgctgggcaagattaatttcgtgaagagcgtcaaccccgaaatggggggcaagttatttcagcaggtaactgctttgcagtttcctgaacccagaaaaatgggttga

SEQ ID NO: 13931 - RNA, 1215 nt, unidentified
  source 1..1215: mol_type = other RNA; note = synthetic construct
atgatcgacaaaaccctggcgggaaagaagcaagaatgcatcaagaacatacgctttatcaaccagcgggccgaagttgagccggagattctggatctgattgaggcttacgcaggtctgaggctggaggaagacaacgaagttctgttctatggcaataaaattacggggaaaaatcgagagttgaacgagtttatagacaagaatcggcacctggaccctcgtgctctcaattttttggcgtcttacttcttggagatgaagaaacgtgggctcaaatgcatcttctcatctagccacttaagccatttcctcaagatctccacaaagaagctgaactggctggcctccgacaaagaagaccactatataagtttcagcgagaaaaagcgaggcggagggataagacagattttcgcgcccaaatcaaccctcaagggcatccagcgccagatcctagattttttactacagtccgtgccactcaattcgcacgctgagggcttccgcaagaagaggagtattgtaacaaatgccaaacggcacattggtaagaaggtggtgatcaagatcgatgctaaaaacttcttcccatcgattacttttgagagggtcctgggaatgttcgtctcacttggataccctcggaaggtttccttaatgctcgcaaaactgacgacccatcaaggaagacttcccacaggtgcccctactagcccagccatctctaacttgatctcccggcggctcgataagaggcttgctggccttggtgaaaaaatgggctttgattacagcagatatgccgatgacatgactatcagtagcaacaacaaaaacgcctccaggatgattcccttctttaaagagattatcagagaagagggctttgagtctaacgaagcaaagctgagaattctccgcagtggaggccgccagaaaattaccggcatcgtggtaaatcaaaaagtcaacgtggatagaaaacagatcaagaaacttagggctactatctacaattgtcgacataaggacattaagcaggaaatgataaagtgggcaaagaaggagaagaatctgaagaatccctatgggtacacacttaaggaatttcgtgccagcttgctcgggaagataaattttgtgaaatctgtgaacgcaaaggccgggaaaaagctgctgaaacagctagacgaactgtcactgaaaacctga

SEQ ID NO: 13932 - RNA, 1209 nt, unidentified
  source 1..1209: mol_type = other RNA; note = synthetic construct
atggacaagaagaagtcatgtggcaataagaaacagtacctgaagaaccttagactcattaaccaacgcgcaaatgtcgacccagagataattgacctgattgaggcctatgcgagactgaggctggattacgacaaagagatttgcttctactccaataaaacctcttctgacaagctggaattgaacaaaatgctcgcaaaaaaccggcatctggatccaaggtgtcttttttttctcaaggcctacttcattgcgatgaagaataagggcttgacatgcttaatcaactccgcacacctcgcccacctcctcaacgtatcaatcgaccatttaatatggttaagcaacgataagtcgaaccagtacacccgatttcacatcaaaaaaagcagcggtgctaaacgtgaaattctggctcccaagcctaagcttaagattgtgcagcgacaaattctggacaatatcctgcagaaaatccagcttaacagccacgcagagggcttcagaaaaaaaaggtctatcctaaccaatgccaaacgccacattggaaagaaagtggttattaagatggacgtgaagaacttcttcccctcaattacttttaaacgggttctgggactctttatcgctcttggatatccgcatcaggtgtctatgaccctgacgaaactgatgactcatgatgggaaattgccaacaggggcccctacttcccctgccataagcaatattctaagtacgaaactcgacaagcgcttcgctaatctgggcgagaaaacagattttgactactcaagatatgcagatgatatctccataagtagcaacaaccgtaatatcacccggatgatccccttcttcaaaaaaatcgtgcaggaggagggtttcgagataaatgaagccaagatgagaatacttaggaatggaggccggcagaagatcgctggtatcgtcgtgaatcagaagttgaacattgaaaagagggaaatcaaaaagatccgggcggtactgtttaattgccgcaacaaggatatcaatcaagaaatcaagaagtgggctcagaaggaaaaaggcctaaaggccagtctgttctatactatagatgagtttaagtcctccatgttggggaagattaactttatcaagatggtcaacccccagacagggcaaaatttgctggaccagctgaacgatctcaatgcctga

SEQ ID NO: 13933 - RNA, 1224 nt, unidentified
  source 1..1224: mol_type = other RNA; note = synthetic construct
atggctctttgtaccaaacaggaaacctacctaaataacctaaagacgataaacactcaggctggggtagagccagatttggttgacataatcgtggcatatgctaggctgcggctcgagcgcaaccttgccattactttctatcaggagggtatcgagaagaaaaccacaaagtaccccagcctgaggactatcattgacaagaaccaagaagctgaccccagagcgttgaacttccttgccgcctattacctggagatggaccgacgcaatctgctgtgtatattcaaccgtcagcacctggccgtcacacttggcgtgagcatttctaacctggaaaagcaggcttctaccgcttcctcaaaatacagccactttttcgcaccgaagaagtcgggcggacagcgtgagatccttgctcctcacccggaattaaaagcccttcagaggaaaattttagacagtctcctggacaaggtaccactgaatgcgcatgcagaagggttcagaagaaagcgctccattgtcactaatgctcagaggcatccagacaaaaagattgtgataaagatcgacatcaaggacttttttccttcaacaaccgcaaaccgcgtgttcggaatgttcgccgccctggggtaccccaaaaatatcgcagccatcctcaccgacctgacaacgtaccagggtagactcgcgacaggagcccccacttctccagcaatcagcaatatactctgccgacggttggataaaagattcgctcggttgggacaagcgaacgattttagttacagtcgttatgcagatgatctgacaatctcttccaatcatcctaaagtgaccacaatgattccattttttaggcagatcgttagtgaggaaggttataccgttaatgagaagaagttgcggattatgagatccggctcacggcaacaggtcactggcatcgtagtcaatcagaaactgaatattcctaggcacgaaatccgcaaactgcgagcagtgattcacaactgcaagcaaaagagcctgaaagtggagatccataagtgggccaagctagagaaaaaccaccctaatcccaccctctatactgaagatgatttcgagaaaagcctctccgccaaaattcattttgtgaagatggtgaacccctcagccgggacgaagctgctcgtggattttaagtctctgggcttacggaccgtcgttgcctga

SEQ ID NO: 13934 - RNA, 1215 nt, unidentified
  source 1..1215: mol_type = other RNA; note = synthetic construct
atggctctgtgtagggagaaagaacagtatctgaagaacctgagactagtcaatttgagagctgacgttgacccagagttagtagatcttctggtggcatatgccggaatgaggctggagaacaacagagatgtgaatttcttccaggacgatgttaaggagcgggcagggaagcacccttacttgctccggttcctccagaaaaacaaggaaactgacccccgcgcccttaattttctcgtgagttatttcctcgagttgaagacgagaggaatcccctgcgtgttcaatcgacaacacttagcagatacattgggcataagcttagtcgccatggacgaactcgcacaaaactcaccaaaatactacacccggtttagcgctgctaagaagaacggggctcagagggagatcctggcgccaaaagccgaattgaagacagtgcagcgtaagatccttgatttccttctcatcaaggtgcccctgaataaccatgccgagggctttcgaaagaacaggtccatagtaaccaatgcacagcgccacaccgacaagaaagtcctaattaagatggacattaaggatttcttcccgagtacaaaagctaaacgcgtcttcggcatgttctttagcctgggctatcccgaaggtgtggcctccaccttaaccaatctgactactttcaaagggagactggccacaggcgctcctacgtctcctgctatttcgaatgtgctgtgtaggcgcctggataaacggtttgcacgtctgggagagaagtgcgatttttcctacagtcgctacgccgacgatctgaccgtctcctccaataatactaatctggccgggctgctgcctctgtttaaagagattgtgctcgaggagggttatgaattgaacgaaaataagctacggatcatgcggtcagggtctagacagaaggtcacaggagtggtagttaacatcaagccaaacatagacaagaacgaaattcgcaaactccgtgccgttgtctataattgccgacataaagacatcaacaaggagatttacaagtgggcccaaatggaaaaatctcatcctgagccgtcacagtacactctggacacctttaagaggagcgtgagcgcgaaaatcaactttgtgaaaatggttaaccacaaagcaggcgaaaagcttctcgcggattttaaagccctttcttggcccggttga

SEQ ID NO: 13935 - RNA, 1317 nt, unidentified
  source 1..1317: mol_type = other RNA; note = synthetic construct
atgcccaacctggcttctcatgtgccagtgcttagccaggttcgcgacaattcaataaaatgccctggcatcatcttcttccctaagaataaccttaagattatgacggagtgtaccgaacattccattttcctcagaaatctagtggaggtcaatcaaagggctggagtcgatagcgaggtcctggatctaatcgagtcctacgcaaggctgcgccttggccggaacagagaagtggacttttacaactgctcgaggcccgtctccgaaaaggatcaggatttaagagcgtttttggagaaaaacaagaacctggacgaaaggacgcggaacttccttgtcgcttactaccaggagctgaaagaccgccacctctgttgcatcttttcaagtgatcatctagcacacttactccagacctctcttcctcggctgcacgccttgacacgagactctcggaactaccacgtcttcaccatcaagaaaagttcaggggcagatcgcatcattcaggcaccacataagcagctgaagactgtgcaacggaagatcctgtccaccattttacacccagtgcctttgaataagtacgccgagggctttcgaaaaaaaagaagcatcctgactaacgccacacaccatgtgaacaaaaaggtgatcgtaaagctcgacattaaggatttcttcccctcaattgacagcaatagagtttttgggatgtatctgcatttgggatacccgaggcgagtagctcaactgctgaccgatttgtctaccgtccagaagaagctgcccaccggggcacctacaagtccaactattgccaatataatatcccgtcggctggacaaacggttcgttaggctcggaatgaaaacagacttcacttatagccgttatgctgacgatattaccataagcagtgacactgacaacatcctcaagatgataccgttttttaaggagatcattcacgacgagggctttactgtgaatgaagggaagatacgcatcctccgatctggttccaggcagagtgtaacaggtgtggtggttaatgaaaagccaaacatcaaacgccgcgaaatcaagaagctgagagccgtgttgcataatagcaaacggggatctctgcacaaacaagcggccatttgggccatgagagaaaaaggcctgaaaaattatcgttcctattcagtggtggatttctatcagagcctgcttgccaagatccacttcgtaagaatgattaatgagaaagccggtaacacgctcctcgctgatttttacaggatcccctggcccgttattacatga

SEQ ID NO: 13936 - RNA, 960 nt, unidentified
  source 1..960: mol_type = other RNA; note = synthetic construct
atggaaatgaaaaacgctggactgacatgtttatttacttgtagccacctgagccatattctcgacgttccgctcaaaagattgcggttccttgcaagggataacggcagctattacaagttcagcatacccaaagcgaatgggacaaagagagtgattatggccccaaagcccgacctgaaggtcgtacagagaaagataaaccatttgatactgcagaaagtgaggctcaataaccgggccgagggctttcgcaagaagcgctccattgtgaccaattccctgcaccatttgcagaagaaggtggtcgtgaaaatggacattcgggattttttcccctcgatcgactttgagagggtattcggggtgttctgctcattaggctaccctcgcggagtgtcactgcttctaaccgatctgtctacttgccagagagttctgcctaccggagctccaacgtctcctgctattagtaacatcatttgtaggaagcttgacaagcggctcgtcctgctatgcgagaaaagtggtttcgaatattcccgatatgccgacgatatcacagtgtcaggcaattccgagcaagtcgttaaaatgattcctctttacaggcgaatcatcgtggatgagggcttcaaagtaaatgaggaaaagctgagaatcacacgctctgggcggcgtcaaaaagttaccgggatcatcgtcaataggaagatgaatatcgaccggagagaaatacgcaagctccgtgcagtcctgaataactgcaggcatggtagtatcgaagagcaggccgatatgtgggcatctcgagaaaagaagtgtactgctccatttaactaccccgtggagaaattcaaaaaaagcttgcacgcccgcatttcctttgttaagatggtgaacccacagatgggtcacagactcctggacgagttccacagcgtgttttcagccggatga

SEQ ID NO: 13937 - RNA, 1215 nt, unidentified
  source 1..1215: mol_type = other RNA; note = synthetic construct
atggctcggtgggacgaggataaagaagcattcatccgcaatctcatccaggtgaatttaagagccggggtcgagcctgagctggtggatctgctggctgcctacgctcgcattcgtctgcaacagggagacaaagtcaccttctactcagaggacgccgacctgcctggctctaggaggaaagctgtgagggctttactggaagctaacagacaccttgacccccgtgccttaagctttctgagtacatacgcagaggccatggtccagcgaggtctgattcccattctgacccgaacgcaccttgcaaaactcctcgaggtgagtgagaatgaattatccgacctagccacttgtactgataggtattacgatgtttttagcatccctaaggctaacgggcagagaagaaagattcaagccccgcggcccccccttaaggaaattcagcagcgcatagccgctctgttggagagggtgaaattgcatccagacgcacatggcttccgcggagagagatcaatcctgactaacgcaaggctccacctcgacaggcaggtggtgatcaatttggacgtgaaggactttttcccgtctatcaccttcgagcgcgtacttgggtgccttggctctctcggatatccccatggcgtggccctgttgctgacccagctgaccacgtatcatgatgttattccaacaggtgcgcctacttccccaatactttccaacctgatctgtcgacggctggatctgcgtctcagccggctcggagatcagctgaacttcaggtattcgcggtacgcggatgacatgaccatttcttcagaggatggcggaattgtaaggcgattgccctttttcaaggagattatacgcgaagaagggttcgaagttcacgaggaaaagatcagagttatgcggaaggggtccagacagcaggtcacaggcgtaatcgttaacgaaaagccaaacctccctcgacaagagttgaagaaactacgggcggtgatacacaattgcctaactgccgacctcgaaacacagagaatccggtgggccctgacagaaaaaggtttgcaagatcctgacggttttgcaatggaggcctttcgtcggagcctttgcgggagggtcagtctggcgagaatggtcaatccaagagcaggcgtgcaactgctcgatatgctaaagcgcgtggagtggcgcatctga

SEQ ID NO: 13938 - RNA, 1176 nt, unidentified
  source 1..1176: mol_type = other RNA; note = synthetic construct
atggagtgttcccatgaagagttcgtgtcgaacttggtggagattaatcaaagggccggaaccgctcctgaactgattgatctgctgggagcttatactcgcctgtgtctcaaacggagtaaggagattgaattctatagtgacagcttgactctgtctaccaataaagccgccattcgaaagttcatctcacagaaccggcacatcgaccctcgctcactttccttcctggtttcatatgccgaaatgatgctagacagaaacttaccatttatcttcaacatcgcacaccttgccaggtttcttgacctagataaggagaatcttttaaggctgatccagaacaaagagtcctactaccattctttttacattccaaaaagccacggcggtaagagacatatttgcgccccaaaagccgagttgaaagcgattcagaaaggaatcctgacagaaattctcgaaaaagtcttcgtacacccgtgcgcgaatggatttagaaggggcagatcgatagtgagtaatgcacaaaaccatgtcggccaggagatcatcattaagatggacatcaaggactttttcccctccataacatttgctcgggttaagggtgtctacctggatctcgggtaccccgaagggacagctgaggccctgacagaactcagcacctataagggccgactgcccatgggagcacctacctccccctatcttagcaacatagtgtccagtcgtatggacagaagattcgccgggctggcccagaaaatggattttcactactctcggtacgctgacgatctggctttcagctctaatgatcctacgtttaatcgctggataccattctttaggcacatcatcgaggacgaaggattcgaggtgaacgaaaagaaggtcgcaattgctcggaagggcgggcgtcagaagctcactggcgtggtggttaatagaaaaataaatacccagcgagacgagtataagaggctccgggcagtcatccataactgcttgaacggggatattcaagagcagatgaagcgatggggtgtatctgaattagatcgctttaaaaactcactgcgcgggcgtatcagcttcgtgaggatggtgaaccgcgagaagggcaataaattgctctctggctttgagcggatcagctggccggcatga

SEQ ID NO: 13939 - RNA, 1176 nt, unidentified
  source 1..1176: mol_type = other RNA; note = synthetic construct
atgaagtgctccgatgagcaatttataagcaacttgatcgaactcaatgaaaaagctaaggtggctcccgatctgatcgatattattaccgcctacgcacggctgtgccaaaggtacggcaaagaggtcaaattttatgacaagaatcccgctatttctacaaacaagcctacaatcaaggactttatagacaaaaaccctcacctcgacaagcgaagcctgtcattcctggtgagttatgccgaaatgatgagaaagcgcggactgccattcatattcaatatcacccacctggcaaatttcctcgaggtagaggatgtcagactgaaacagttgatcaaatacaaggagaagtcttatcacaacttttatatccccaagagcaatggcggaaaacggttaatttctgcaccgactgaccatttgaagaccattcagagaaaaatcctcaaagacatcctagagcgggtttcacttcacccctccgcaaatggtttccggattggacgcagtgtaacaactaacgcggaaaaacatactggccaggaggtggtgatcaagatcgatattaaagatttcttcccgagtatcacgaaccagcgcattaaaggcatttacgttaaccttgggtatccagatggagtggccgaaaccctgacagggctgagcacttataagggtaggttgcctatgggggcaccaaccagtccttatcttgccaatatagtcgctacccgattagatcgccggttcgctaacctgtcgaagaagattgacttcgtctactcaagatacgccgacgaccttgccttctctagcaaggataagacatttgctcgctccatccccttttttaagaaaattatccaggatgaggggttcgaagtcaatgaggaaaaggtggttatagcccgtaaaggaggccagcagaaagttactggcgtggtggtgaatcgaaaggtgaacattgagcagaaagagtacaagaggctcagagcggttgtgcataactgtgtaaacggagacttaagggaggagatgaaaaaatggggggcctcctccctaaatgaatttaagtcaacgttcctgggtcacatcaactttgtgaagatgctgaataacgaaaagggttaccgtctcctggacggctttaggcaaatcagctggccagtctga

SEQ ID NO: 13940 - RNA, 1131 nt, unidentified
  source 1..1131: mol_type = other RNA; note = synthetic construct
atggctaactgccccgacgaacgattcataagtaatcttatcgagctcaacaagagagctgatgtcgatccagaaattattgacctagtcgccgcatacgcacgcctctgtctgaaggatggcaaggagctgaacttttacaaggagtatctggccctctccaccaataaacctactatccagagattcattgagaaaaatgcctcacttgacaagcggagtttgtcatttcttgtctcttacgctgagatgatgaggaaaaagcggcttcccttcctgtttaatcgagcgcacttagcaatattcctgggcactaaagagggagagatcgaagccattatccaaaataaggaaagctactatcacactttcttcatccccaaaaggaacggggatgagcggcgtattacagcgcctaaggaccgcctgaaagagatccagaaaacgatcctgcggaagattctcgagaaagtgtccgtgcatttcgcagctcgcggtttcaagcggagaagtagcataatctccaacgcacacggacacattggccaggaaatcctagtgaagatggacatcaaagatttctttccaagcatcacctacgaaagggtcaagggcatatttatcaacttagggtaccccgaaggtgttgccgaggcactgaccgaactgaccacctacaaaggccggctgccaatgggagcctcgactagcccttatctgtctaatattattgctatccgcatggacaagcgctttacaggcttggcgaagaaaatggactttacatactctaggtatgccgacgatctagccttttcatctaaggatggaaacctcaagaggcatataccgttctttaaggagattattaaggacgaagggttcgaggttaacgaacagaaagtggtgatcgccaggaagggtgggcagcaaaaagtgaccggtgtagtggtaaatagaaaagtcaacgtggagaagagagaatataaaagactccgagctgtgatccataactgcaaaaaaggcaacttgaagacggaaatggctaagtggggggcctccaatcctggagagtatgagttgccacgtagcaaactgacaggatatcagaagaatgttaattgttgctga

SEQ ID NO: 13941 - RNA, 2643 nt, unidentified
  source 1..2643: mol_type = other RNA; note = synthetic construct
atgaaaaaggagaagcaagctactcgaacactgtccaatcccattcaaaacgacgtgctaaaaaataggctccagagcatctttcggtcctttaggaaagccgaccggacagatattaaatccgtggaggacgctctggaccggctccaattcctggccttccctgagttctaccaggcctgtttgttcctactttgcatcgagtgcgaaagatgtgtagaggccaatgtgccaccgagcgtcattcgggccgaacgcattgtgcaggctgttgaagcgaaggccgccgcaggtatgcagggaaggctagcctattggattaaccagaagctgactaccagttatcccctcggattagtgcagcgcctcacggcctattcacataagattaacgagtcacgaaacacccagtgcattaccctcgtggatgcaggtagacatgaggaagccctcgccgtggctgaatctattgaggatacagaacaacagtccaaggcattgtgtgcgatcgccgccgactttgcaaggttgagccagaaggaaacagctgaccccctgttcaaaagggctctggacctgatcgaaattttctatgcctacacatttgaagatgcagatgaatcaggatatgggggcgactacgatgagtacctgcaggtgaagggtaaatgtacccggtatatggtgggaaagatggctgaaataggctggtttaaacgggcagaagagctaagcaataatatcgaggacgagtggctccgaagtgaggctttttgtaatatagcaaaagatctcgctgcaagcgggcatttatccgagtcctttgaggcggcagcaagatcaggaccccaccagtctatcgctctggggtgcatcgctgaaactattgctaaaagcggcaacttcttccaggccttgaacgttttctctaaagccaatgacttggcagcagagcagcaaggcctttggaaatcaaaatgcctgttatctgtcgctgctggcttggttattatcgggacgaaaaataaggctcgcaaagtggcggagcaggccagtgaagttatcatcgacagcatcaagttctacgaagacgacgtaaaccagccagcagatatgagaatacggttcgtcatggacctcatggaggtcgggggctttgaaactggtattaaggtccagatcgagcccatacatgaaacacttgatcttctagcacagtataagtcgtggttccgcgtcctggatcggatcttctcttcaggaagtattgacgccctgttgtttaagtgctacctgaacggctttgccagttccgccgtgtttggcaataatcgcgctctcatgatgaggctgattcgtgaggcatgtcacatggtgagtagcgacgagaaacctgaggtgtttcttgctctaagtaacgaactcgccctgctgggcatcaatgatatgcgcgatgatgctattgtgcgagctatcgtggcgggatccgatcacttgcgtatgcagcgggaagagtacatcaagaaccctacgccttcactccccgataatcaaccacacgctgaggagccgcttatacctgaggaatggccacaggaaaacacccggatatcgaacatcctcggtatctctgttgagatgctgcgcctggtgagactgaaagtgattcgcgctcaaggctacgacgcgtttaggatcccaaagcgaagaaagggctttagggtgatccacagccctcactctgatttagcgcacattcagcgtcgaatcaaagaatgcatccttgatccagcccctgggctgccaagctgtgtcacagctttcagaccaggagtatctataagggataacgccatggtacattgtgacaaagcggtggtggtaaaatttgacctcgaagacttcttccccagcatttctttcacccgcgtcatgggcatctttcactccctgggattccccacgaatgaggctaggatgttggctaatctgacaaccgtgcaccttgacgtgtccagttctggcccggttgtcaagtctgtatccaggagtgccgaggcattttatcagactaagcatctcgtcgacttgctgcatgagtaccccgtcaacatacgtttactggcataccgctggaactacgggaagatctctagagcactggccttaaggatgttaagaaagagaagacggaggggtcttccacaaggggcctcgacctcacctcagcttgccaacctggccgccgttaggttggatctccgccttcgtgcccttggggagtccatgggattcgcctatactcgatacgcagacgatctgactttttcaagcaatgaacggctcgccaaggtggatgcgctgacaagcctggtcgacgagattgttgtggactgcggattcagactgaatggccgtaaaaccaagataatgcgggccccggccaccagaagagttactgggctgattgtcaacaccacaacccctaaggtacccagatccatgctgaggaaggtgcgggcaatgctgcatcaacaggccggtggcaagctgagcgaggcggatatccaccgcttgcgcgggtatctgagcttcgttcgaatgatcgacaaggagcaggccgatctcctgctggactgctga

SEQ ID NO: 13942 - RNA, 1155 nt, unidentified
  source 1..1155: mol_type = other RNA; note = synthetic construct
atgccagctaatcgagcccttgggctgcccgccatcgaacatcgtcgaggcaacactcccaagaggggcatcgcacccactactcagcaggagtccagatggcggagtgggtcctctattcggataaggtggacgggagatgctcgggttcgtagcggcgatggcttcgtcgagccactcgatttccgatcactggactctgcagacgatgtagccaggatgacgggccttgatatcgaagaaatccgtgcaatcgcttggagaacagaggctccgcgaggtggctggtacaggaggaccctgattccgaaacggcaggggggcttccggttgattagcacccccattcctagattggctgcggcacagaggcgcatcttagctgcgattggcccccatttccctgtgcacccagcagctactgccttcagactgggtatgtcagtgcgggtaaatgctgcctgtcacaccggccgccctatcgtcgtgcgcatagacctagcggacttcttcagtgcagttagatttggacagatccaccgcgccttcgaatgtgccggatgcacacacgaggccgcaagaattcttgcgtctctgacatccgacgtagctgccaccgttcgcccaaggggtcaccgtacccttgtggttgctggtcgcggtggattaccgcaaggcgcgtgtactagcccagtcctcgccaacgccatttgctgggatctggatgaagacgcccggaccttgggacggagactagggtttacctatacgcgctacgccgacgatctggtgtttagcgcaggcaatagtcgcgcaccagtggatacactcatccgggaaacacggagaataatccaggcctatgggtttcacgtgaacgaagccaagaccagggtcatgagggcaggcgggaggcaagtggtgactggactcgtcgtcaatgggtcagagcccagagtgcctaggcctgacttgagacgctttcgcgcctttctgcatcactgcgagacagaggggctggacgtgatgtccgagcgaataggaaaagacgctctcaactacgctcgaggatatctggcatgggttcacatggtgtcgcccgagcaggccgctagatttagggcccggcatccttggctgggtggacatgggtga

SEQ ID NO: 13943 - RNA, 933 nt, unidentified
  source 1..933: mol_type = other RNA; note = synthetic construct
atgaacgctgcggaggattccctggacctccaggatatctcatcctttctaggattcgctccccagcatattttctatctggtagaggacccggataaattctacaccactatcagaataccaaagaacagtgatccactcacctatcgcacacttgatatcccctacagtgagctcaaaggagtccagagagttataaacaggaagattctgcagaagttgcccttaaatgactgtgccttttcatatgtttcaggcaaatcgatttacgcagctgcccacgagttttgcggtggcaaggccgtgctgaagatggacattgcagatttcttccctagcatcaccggccagagggtgttgggactgtttaagtctcttgggtttaaccagagtatctcttacattttgtcccaactctgcttgcgcaacaattgtattgcccagggcgctccaacttctcccgcagtgagcaatttaatcatgcgccggtttgaccgacagatggagaaactcgccgccagttgggaaatgtcttatctgagatattccgacgacgtcttcctgtacaagaacaagaacttcaatcaccctaagcttgctttttatgtcacaaggatcatagaacagaatgggttcgcagtgaatcagagcaaaacacgtttccaccctcgagggcaacctcgtattactctgggccttctaacacatggagataagccgtccataccaggtcccgccaggaggcaatatcgggcagccttccaccgggcgagcagagattttgaatgggcttaccataacgaagcccggctgaaagggattctggagtggtacaaatcagtgcatggtaaagacgacgcgtacaaccactactcctctatccacaagaatatcaataccctgaaaatccatacgagctaccgcagccaatga

SEQ ID NO: 13944 - RNA, 933 nt, unidentified
  source 1..933: mol_type = other RNA; note = synthetic construct
atgaatgccgcagaagatagccttaatctaagagatatcagcagttttttgggattcgctccacaacacattttctacttagtggagaacccggacaaattctataccacgattcgcatcccgaaaaattccaagccacacagcttccggactctggacattccctatacagagctaaaaggagtgcagcgcgccatgaaccgtaagattctgcagaaacagcccctttcggaatgtgcttattcttacgtgagtggcaagtcaatcttctccgcggccagagagttctgcgggggtaaagcgatcttgaagatggacatccaagacttttttccaagcataactggtccccgagttgtgggcttgtataagtcactcggttttaccgattccgtggcttacattctgtcccagctgtctctccggaataacagcatagcacagggcgccccaacaagccctgcaatcagtaatctcattatgaggcgctttgatcgccatatggagaacctggccacctcttgggaaatggactacctgcggtactctgacgacatcttcttctataaggataggaactttaaccaccctaagctcgaggagcttgcaacccagatcatcgaacacagcgggttcacagttaatgtcgctaaaacgcgataccatcccaggggcgtaccccggattacattagggctcctgactcacggggaccgacctagaatccctggacctgctcgcaagcagtatagggccgctttttatagagcctctagggactttgagtgggcctacgccaacaagtcaagactgaaaggaatactggaatggtacaaatccatacatggcaaggatgatgtcttcaatcagtacagtgcaatttaccgtaacatcaataccctgaagattcatacttcatatcggtcccaatga

SEQ ID NO: 13945 - RNA, 975 nt, unidentified
  source 1..975: mol_type = other RNA; note = synthetic construct
atgaggtttattgcgtggcatcgcgaacgggaggaggtgggaatgggtgccgccgatgattgccaggatctcgccagcatcgccgattatctcggctttgcacctcagcatatcttctatttggtcgaggatcccgaccggtgctacgtgtctatagaaatacctaaaaacagtgacccgaccaagctgcgcaagctcgatatccccatttctgaacttaagggcgttcagcgggccattaataaaaagatcttgtcagaattccccgtggatgaatgcgtacactcatatgtgccagccagatccattctgaccgccgctcgggaattctgtcctggtcgtgcagtgctgaaaatggacattgaggacttttttccgtctatcacatttgtacgagtccttgggttgttcaaggctctagatttttctgacagcgctagctttatcctagctcgcctcactaccttcgccgacagactggctcaaggcgcaccaacttcacctgctctgtcgaacctgatcatgcggggcattgatttcagactgaagagactggctgcaacgtgggaggttaaatacttacgctactccgacgacatcttcttccacaaggagaaaaatttcaaccacccaaaattgactgcgtacctcagtaaagtgatagaggacggtggatttacggccaacaacaaaaaaaccaagtaccaccccaaggggcttcctaggacaactctgggactccttacacacggggagaagcccaagattccaggaagccagaggaggatctaccgttccatgttctttaaggcaagtaggaatatccactgggcacatgagaatagagaaaagttacgagggataattgaatggtataaatgtgtctacggcagagacgacacctatacacaatatcgagccattctggacaatgaggccaggctgcgcatccatgatacctaccagtccaagtga

SEQ ID NO: 13946 - RNA, 933 nt, unidentified
  source 1..933: mol_type = other RNA; note = synthetic construct
atggacgccgcagcactatgcctggatctcgaaaccctgagcggctttctcgggtttgcgcctcagcatatttactatttggttgagagcccagagtcatattacacaacgataagcatcccaaaaaaatcagaccctatgaaggtccggcagatcgacattcccttttctgaactcaagggggtgcagagagccatcaataagaagatactgtccgagcttccgatgtcggataacgtgcatagttatgtgcagggccgcagtatcttaaccgccacgaaattgctgtgtcctggtcgtgccattctgaaagtcgacatcgcagattttttccccacaattacctaccgtagggtattcggactgttccggcgccttggctataatgatgctgctgccttcatactgtcaaggctatgcactaaggacgataaactctcccagggagctcctacctccccggcaatctctaacgccataatggccggtcttgataagcgaatggagcgattggctgagacttgggagctgaagtacctccgatacagcgacgacatgtttttccacaaggaacggaatttcaaccatacacgcctggctgacgtcgcgtccagtgtggttgagtcctctggctttatcattaacagcagcaagactaaataccaccctaagggattgccccggatcacacttgggctgctgacccacggaccagaacccaggattcccggtccacaaaggaaaaagtatcgcgctgccttctttcgcgcctctagaaatattaattgggcatacgaaaggcaagcccagttaaaagggatgctcgaatggtataaatgtgtgcaaggccggagtgacgagtacatccagtatcaggcgattttcgagaacatcgaaagactgaagatccacgattcttacagatcaagatga

SEQ ID NO: 13947 - RNA, 921 nt, unidentified
  source 1..921: mol_type = other RNA; note = synthetic construct
atgattgctgcacagattcaaaccctggaagatctgtcaggagccctgggattcgcgcctcagcatttgttttggcttgccgggaacagcgatgccctgtacaaggagttcgacattcccaagcgcacaggcggagtgaggcggatcagtacccccatagccgagttaaagggagttcagagaaccatactccagagggtgctccagctgcatgctgtgtccgatgccaattttgcctacgttaaaggcaagtctgccgtcgctgcagccagaaggcttgctggggagaaatccttgtttaaattagacatccgggagtttttccccaccatcacagctcgccgagtgttcggcctgtacagatcttttggtttccctaaccctactgcatacctgctcacttctttaaccacgtatcgcgggtccctttgtcaaggcactccaacctcaccgtatattgccaatctaatctgccgaggcatggatacacagctgagtggtctggccagttcctggggtctggaatatatccggtactctgacgacctcttcttttacagaaaccgtatcttcaattggagcaagtttgagggagtcgtcactcggatcgtggtacagaacggcttccacctaaatgccaacaagagccgcttctacagggcagggaaagatagactcactctgggcctggaaaccgggcaaaggcagattcggcttcccagggcaacaagacgcctccatcgtgcggcgtttcacaaggcctccatgtcacctcggtgggctgctgacaatctcccacaattgaacggcatgctgagctggcatcgagcagtgcacggaaaagatgacacagcgagcgcatatgggcgtgtattgcagatagctacatcgattaaacaccacgacccatattcaacgtga

SEQ ID NO: 13948 - RNA, 927 nt, unidentified
  source 1..927: mol_type = other RNA; note = synthetic construct
atgacaactgcggccctctcactcgagttgcgggagctgtccagtgagttagggtttgccccacagcatgtattttaccttgttaagtgtgccgacgaactctacttcgacatcgaaattccaaagaggacacctggcgagtttcgaaaaatttcggtgccaagaacggaactcaagggcgtccagagggctattctgaggaagatattgtctagccacgagccatctgaatttgcccacagctacataaagggaaagagtgttatctcagccgctaagaagcttttgggagaaaaagccgtgcttaaagtcgacctgaaaaacttctttccggcaatctccgctcgtcgcgtattcggactgttcagagccttaggatttagcaacaaaaaggcgttcatcctgaccaaactcaccacttataaagggacactttgccaaggtgcccccaccagccccgcaatctctaacttggtgtgtagatccctcgacaagaacattaatgcactggctatctcctggaagctgaattatctacgctattgcgacgatatctacctgtaccatcggatcaatttcaattcagataagcttctgacgcgcctgcggcgaaccgtgaatgatcacgggttctcactgaacgaagataagacccggtattatgcagctggtaaccctagaattactctggggttatctacacatggccgtgtgctaaggctcccccgagctatgaggcgggagcatagagcggcctttcacaaggcctccactagtcctacatgggctgaggcaaatctgagcaaattgcgcggcatggccgagtggcacaaagcagtgtatggcagcgatgctacctacaaacactaccgcgaaattataaaaaacgtccctctgatgaaggttcatgagcccttcgcaatttga

SEQ ID NO: 13949 - RNA, 909 nt, unidentified
  source 1..909: mol_type = other RNA; note = synthetic construct
atgattagttccgtcgacgacttcgctagccgaatcggcctgtctgaattctgtctcaagcgcctgattttaagatcggagtccttctacagtagcttctcactgccgggcaggtctggtagacgccataacatcagcagccccgcgacggaacttaagacagtgcagagatggatcctgaaaaacgtcctttcaaggttcgagttgcacgaagcatgcgttgagggacgcagtcgcagcaccccaaacgccgacagcttcgtgttaaaggcgtctctgaaatcgttcttcgcaactctcaaccgggcacgggtggaggggttgttccgttccctcctgtttcctgagtctgttgctgtgagccttgcccgcctcaccacgtttcttaatgcactgccccaaggtgcccctaccagtgtgtatatcgccaatctgatatgtagacgcctcgatcgccgagtgaatggactgtgtggagttaggaattggtcttaccgacgtgattgtggggatattgtcatttgcggccagggtagagtcactgacaaagtgttggagcagctgacacagatcgccagggaagaagggtttgacatagaaattcacaaacggaccagctgcaacggagctacagacggtgattccaagaccggcccagtgactggccgcgtatcctcacagggggctgatctgtcctttaggagattgcggaggactaagtctcaacggagaatcgtgggccggcctgcccgaaaacagtcaagagctcggtcctcatttgcatcacgtctacccgagctctgcggactagatagatcctttacagggagtgccaggcagaagagggtacgggccgagttaaggctgctgtttaattctgctgtcggcaatagtagcaacacccgatga

SEQ ID NO: 13950 - RNA, 972 nt, unidentified
  source 1..972: mol_type = other RNA; note = synthetic construct
atgtccatcagattcggcattgctgagcgcttggtgctgctgcttgtcatcaagatgattgagacttcaagaagcataaagatggacaaccttcttgagacactggaaatctctgaactggagctcaagcgttacgcactccgtgccgagaagaactatcacgaactacataggctgaagaaatccggaaagacacgaagagtggttgccccaagcgcagaactgaagggcctccagcggaaaatttcaaggcgaatactccggcatcacgatctgcaggacagttgtacggggtataggccaggccactctattgtcaccaatgcccgcccccataccgggaaaaggtttgtactgaacatcgacttgaaagactttttccccagcatcagcttcaatagggtggtgggattataccagaacttgggtatggaccgcaatgctgctcggctgttggctagagcaaccacatataaaggtgcccttccgcagggcgctcctacttcccctgatattgccaacctggtgtgtaggacactcgataagagactggaagggttctgcaaaatccgccagtggtcttacactaggtactgtgatgatatcaccatctctggtgacacttgcacagatggggccatggataccctccggaccattatagagagcgaaggattccgcattaacgaagacaagacacggatgcgcatgagtcatcagagacagaccgtgacgggcgtcgttgacaatgagcggcctaacttagagatcagcgagcgaagaaagctgcgtactatatgccaccaacttagatggaatcccgagtcctttgaggggctcggaaagaagctgatgggctcattatcatttgcgaatatgatcggcggattgctacggaaaagtgagtttcaatccgcgtggaggctgctgaaaaaaaagcaccacgaagcccgacatgcatcgactacctga

SEQ ID NO: 13951 - RNA, 1101 nt, unidentified
  source 1..1101: mol_type = other RNA; note = synthetic construct
atgtttaggcagccggacgtggtcggcaatttccagctcacgattaagctattagggcttggcagcaactctgtgatgcatgaaagcagcaacgctggaaacgaacggctagaaaggatactgccttcgggcgtgaaggagagctttccagtattctacttctgcgaatttgtgcaccgaagagaggctggagtgctcccagtcccctacatgtacgacatccagacagtcgcgcagctggcaaacgctctggattcctcagagttcgagctgctgaggttcatttaccgggctgaagagttttacacccgcttcagaaagaaaaaaagtactggcgatatgcgtactgtggccgcccctcgcaagcccttgaaggctgtccagaaggcaatcgttaagaagtttttggccgatattcccctccctgatgagtgtactggtttccggccaggaatgagcatcttgtccaatgcccagccccattgtaagaaacgtttcgtctttaataccgacttagaggatttcttcgggtctatctcctcagaaagggttctgggcctgtatttacgcctcggctttagctttcccgtagcctgtgtgctgaccgaactcacgacctatattgggtgcttgcctcaaggagccccctcatctccatatcttgcgaatctgattgcatacagtatggacgccgacttggctgacttttgcgccgcaaatgaatggtcctatacaagatattgcgacgacatcacaatatctgggaacgggaatttcagtctcgccgatatgagaactattagcgatatcgtggaggtggagggttttaggatgaacatcaaaaaaacccgattccacaagcacaactctaagcagatggtgagtggtctggttgtgaacgaaaaaccgtccctgccacgcgccaaaagacgaaaaatccgggcaatttttcatcaagctgaggttgagcctgaacggtacggaaatcgcgtgaaagagctggaaaaccacctttcaatactttctatgctggaccctcagtccaaggaggtcgagaagtataggacagtactcaatcggctgatctcgcaagcaaaatga

SEQ ID NO: 13952 - RNA, 918 nt, unidentified
  source 1..918: mol_type = other RNA; note = synthetic construct
atgaccacgattcgtcgcatggacatcttcgaattggtcgaacagcttgagacttctgaacttcatctcaggcatctcgccacccggtcagagaggttttatagggagttcgtcgtggccaagaaaagcggcggagggcggaaaattgtagcaccctccgacgaccttaaagatatgcagaaaaagattgctgtcctgctcctgaataaggtggacttacacgaagcttgcactggctacagaaatggtaagtccattatcgataatgctcagcctcatgtgggtcagcactttgtgctgaatatggatcttaaagacttctttcccagcatatcttcaaacagagtcaccggactgttctataacctggggtgggaacggccagttgccatgctgctcgctcgcatcaccacatacaagggcagcttgcctcaaggggcaccgagttctcccgccattgctaacctgctatgccgtcgactggacacaagactctccaactttagtagagttagggggtggcagtatacaagatactgcgacgatctgacaataagcggccagggtactccagactcagatactgataccatatattccatcatcgagagcgagggatttacagtgaacttggacaaaacgaggacccgatttaagcaccagaggcaagttgttaccggaatcgtggtgaaccaggaggtacggattccccgcgaacagcgaagattactgcgggcaatctgtcaccaaatgtccatggagccagaaagtttccgcggcgtgtctaatcaggtcctgggccagttgtcattcgcccagatggtggagggacaaaatgcacctgagacataccgggagtcggcgcagtgtctcctggatgccaagaagctagcgcgccaagccggggctacttactga

SEQ ID NO: 13953 - RNA, 957 nt, unidentified
  source 1..957: mol_type = other RNA; note = synthetic construct
atgctcatcgctagcagttgcaggcagagggaacccctgacggcttgcgacggccatccaaccttacgcgggggtgcaaggatgctgcagaccaccgatgacctggccgccctgttaggcgtcgaaacggccaccttggttaagttagcggatcctgccaggactcggtggcggcatcatactgttcctaagcgatcaggagggacccggcacctcttcgaaccccctcatgcccttcaggtcgtgcagcgtgctataggaagaaaaatcctggacagatacactccacacgatgcagcgaaggctttccggcgaggcgcatccgttgtggaccatgctcaccagcacgtgggacaggctttcgtctattctactgatctgcgcgacttcttcccgcagatcaatattaggagggtgcgtgggatgtttctgagccttccaggcctcgattgttccccaagcgtggccgagcttcttgccaggctgctctgttggcgtggatgtctaccgcaaggcgcccccacttcacctgcaatcgccaacctaattgcatatcgcttggacttgcgcctcacaaactactgtcagcggaggggttggacatatgggagatacgctgacgatataacaatttccggtagaggcagatttaccgcacgcgaccagcgatgggttgaagggtgcctggccgccgagggatttcctgtaaaccccgctaaaacagacctgcggcggcagcacgagcggcaaacagtgtgcggcctgctggtgaatgatcgcgtgagactgccacgccaaaccagaaagcagaaaagagccactgctcacgccctgacacaatctaccgaccccgagacgcgaaccgctcaagcacacgggaatctcggctggctcaaaatggtcggaaacgagcaggcgttggtgacacagtttcaggtcgcagtagataagagttga

SEQ ID NO: 13954 - RNA, 903 nt, unidentified
  source 1..903: mol_type = other RNA; note = synthetic construct
atgccaagcctgtcgaagaccttgccaaccattgcgacactcttggacctggcggagttcttatctgtcagcgaatttgagctgaaatctttctgcttaagaccgaagaaattttacaacacattcgagaggcctaagcggagtggcaagggttgcaggaagatctgcgccccatccgaaaaactcaagtccgtacaaaagatcatcaaggagaagattctggactgtgtcgatgcccatgaatcttcgactggctacaaaagaggtgtgtcaatagtggaaaacgcccaggtgcacgtcggaaaaagggcattgctgaacctggatattgagaactttttctcctccattagtatgcccagagtgattgggctattcgctagcctggggtatactgaagacgttgcaatcatgttggggcggctctgttgctttgaacacgcacttcctcagggcgcacccacatctccctcactcgccaatctgatctgccacaaacttgatcggcgactgaaaggcctcgcctttaaaagtcacatgcagtacacaaggtattgtgacgatattaccctatcttccgacgaaaatatctcaggaaagttcgtggaggtggtgaaggagatcatcaaggatgagggctttagcgtaaatgaggataaaactcgcgttcttagccaacgcagctgtcaaattgttaccgggcttacggtcaatcagaaggtgaacctgccccgcgagaaaagacgtctcatacgagcttcattccatcgcgctagccagcaaacggctttaactgacgccgagcagaaaaggctggaaggactggccagtttcatgcagatgatagagcagcattgtcagaagcagcggagacgtgtctcccctaccgacatcaagtcttga

SEQ ID NO: 13955 - RNA, 1083 nt, unidentified
  source 1..1083: mol_type = other RNA; note = synthetic construct
atgggaatactctcttggatgtttggtatcaagagcaagaagtacaattacagtaaagtggagaaggccttgggaccttggcaaccatatgcgggcagctctgtgattcacgggaccatgctgcctaagtcatttaccattccccccgctctaaagaagaagagagatgagcccgatctgactaccttttcctccgcattattcccatactggttaaggatcgacccgtcgctggcaggcttcgtcttgatgaaaatcaacagtggggaaatgtatagacaaaaggaaatccctagggagggaaaagctcctcggattatatccgttccggcccccgtactcaagttcatacagaaaagaattcttgcccgaatgctggaacagatcgagatccatccagctgcccatggatttgtaaaaggtaggacaatcttctccgctgccgagcctcacgtggggaaacgcattgttctcagcattgatctgcgggatttttttggcaccatctcctttaagcgtgttgcgggtatgttcaaggcatacgggatcgccaaaaaacaggccttcctccttgctggcctttgttgctgtcagaaaaaactcccccagggagcaccaacgtcacctgctatctctaacattgtctgcaggagactggacagccggctagccgggttgtgtaaaaagtatgacttctcatacactcgttatgctgatgacctgatattttctggagacgagagaatgctgcggttcttaaaggtgtttaaggagatcgtgcagaaagaaggcttcgcagtcgcagatgagaaaacattcatccgccgcagcggctctcgccagaaagtgttggggctgaacgtcaatagcaaggtgagtgtgccccgcaaggctaggcgactgattcgagcgatggtccatcggcaggcccaagaaggttcacccgacggcgaaatggttgactttctgcttggccacgcagccttcatgaagccagcccacccagagcagtccgctaagctgaaagaaacactggacaagacttggaaggcctacctcgtgagttgcattgccaataaatga

SEQ ID NO: 13956 - RNA, 1047 nt, unidentified
  source 1..1047: mol_type = other RNA; note = synthetic construct
atgggactgctcaattggcttttcggaaagaagtcccataagtacaactacgggagagtggagaagatcctgggtccttggaaaacctattccggcaccctttgtatccctggtactaaactacctaagagttttactgtgcctcccagcctgaagaaaaataaggatgatgccgaacagacaacgttgagcgccgccctcttcccctattggctgagaatcgacccatcattggcaggcttcgtcttatccaaaatcaagtctgaggaaatgtacaagcagaaagagatcccacgtgaaggaaaagcgccgcgaatcatttctgttcccgcgccgattctgaaatttatccaaaagcggatccttgcacgaatgctggaacagattgaaatacaccccgcagctcacggctttgtgaagggccggaccatattcagcgccgcagagccacacgtgggaaaacggattgtactcagtattgacctcagggacttctttggcacaatttccttcaagcgggtcgccggaatgttcaaagcatatggcatagcgaaaaagcaggcttttctgctcgctgggttgtgctgttaccagaagaaactaccccagggggctccaacaagccctgctattagtaacatagtctgcaagcgcttagactcacgcctggccgggctgtgccgaaagcacaacatcaattatacaaggtacgcagacgatctggtgttttctggtgatgggagaatgttaaggttcctgaaggtgtttaaggaaatcgttcagaaggagggattcgccgtcgctgatgagaaaaccttcattcgcagaagcgggtctaggcaaaaagttctgggcctgaacgtgaatactaaagtatcagtgccaagaaaagctcgccgtataatcagggcaatggtccataaacaatcgcaggaaaagaagcccgacgatgagatgatcgcctttctcctgggccacgccgcctttatgaaaccagtgcatcctgagcaggctgccaagcttaagaacattttggagaatctctga

SEQ ID NO: 13957 - RNA, 1047 nt, unidentified
  source 1..1047: mol_type = other RNA; note = synthetic construct
atgttcaagtaccttaaaaacatcctgggggtcaaatcacgcaagaagtacaacttcttcagaataaatcggattttgggagattggcaaccctattcgggtagcaaatgtataaaagacacaaaactgcccaagtacctcgacctaccaaaggatgtagaaaaatggggcgactacagcggacaggtgcccctgtctacagtgatctttccatactggcttcgcctctcaagcgagattgctggattcttggtgaagcaagtgaattcaggtaagctctataatgacatcgagattcctcgagaaggaaaagaccctagaaagatttccagcccccatcccctgttaaaattttttcagcgcagaatcctgactaggctgctggagcagatggaggttcatccagccgcacacggctttataaagaaccgtagtatcttcaccgccctcgaaaaacatacagggaaaagagttgtgatctcactcgacatccgggatttctttgatacaatcacgttcaaaagggtctgcggattatttaagggctatggcattaaggaagataaggcccttctactggccggtctatgttgcaggaatggtaggctgcctcagggagctccgacttccccgatgatctctaacttgatatgcaagaagatggactctagacttactggcctggcagaaaaaaacggattcagttatacccggtatgctgatgacctgatttttagtgggggggaaaacatcctcaagttcctcccaataatcaagcagatcatcaaggaggagggctttacccctgcggaggagaagaccaaaattcgacggtccggcagcaggcagcaagtccttgggttgaatgttaatagtaaagtgtccgtgcctaaaaaggtcaggcggctgattcgagctatggtacaccgccaggccttaagcgagggccgcaaccacgaaatgctgtctttcctgtacgggcacattgcctttatgtccaataagcacccagagcaggcagaaaaattgaagcgtcagctgatttga

SEQ ID NO: 13958 - RNA, 1053 nt, unidentified
  source 1..1053: mol_type = other RNA; note = synthetic construct
atgcttaacctgctaaggaagttgttccacctgcccccggctaggcgtcgatttccctcccaggccattgaggacgtgctcgggccgtgggaaccttatgctggcgatgacgtgctgcccagaagtcgcttacctgcacgccttgaacttccacccgcggtcgccgaatggggagatgttccaggcgcacgtcgcttggaccgggttttatttcggtgttggctgaggctcgaccccacgctcgtgggattcctactctcacaaatccagcagggggagctgtatacagtgcacgaaatcgatcgcccaggcaaagccccgcgaaggattgccgagccagatagagtccttaaattcgtgcagagacgcattctggagcgcgtgctggaacagatggaaattcatccagccgctcatggcttcgtaaaaggccgctctattttcactaacgcagagcaacatacccagaaggctatagtcatcgcattggacgctagggattttttccctacgatcaccttcaagcgggtcaatggcatgttcatcaaatctggctttgcagccgacactgcagggaaactggccgggctctgttgcttccgtggaaggctgcctcaaggcgctcctacctccccaatgatcagcaatcttatctgccggcggctcgatggaaggctcagtggacttctaactaagtttggcgggacatacacccgatacggggacgatatgacttttagcggtcccgaacagatactgtcgctgctgcctctgtgtcggcgcatactcgcggaggagggtttcgagttggcgcctgagaaggtgagaatttgcagaaggggtagccggcagaccgtgacaggtttggtcgttaacgataaggtatccgtgcccagacgggttagaagatacatccgggctatggtacacgcccagtcaagatctgaccaccccgatgaagacatggtgcgatttctgaggggacacttaagctttatgcgaccagcccatcctgaccaagccgagcgtctgctgcagcagctgaatacatga

SEQ ID NO: 13959 - RNA, 1086 nt, unidentified
  source 1..1086: mol_type = other RNA; note = synthetic construct
atggattttgtggcttatttgataatggacttgatccgacttctgacaaacaggaaagagaaaccatacgacaggaaaagggtggacaaaaccctcggaccgtggagcgcgtttaagggaccctctgccgaatgtatccctggcacccggctgcctcgcaagattgtctggcatagacccaggctactgttcgggaggaaacgcgaggaaattgatttcgcaataggcgtcatgacacattggttacgcttggagcccaagttgatgcgcttcattgcatacttcctgcgggatactgaaaagtacaaagtgcgggagataccaaggcccggaagagaaccgcgccggattgaagaaccgatggccctgctgaaatttgttcagagacgtatcttgcgaaggatcctagagcagaccgacctgcccgattgtgtgcacgggttcgtacggggccggtcaattggaacagctgccgcccctcacgcgcataaggaggttgtcgtgtgctgcgacattgagaacttcttcccaacaatcactgtgaggcgagtttggggcgtctttcggtccttgatcgtgaatcctcgcgtcagcaacctcctcgcagctctgaccacttatcaagggagactccctcagggagctccaacgagtcccatgatcgcgaatctggtgctcaggcgcctggatagacgactcgccgcccttaccagatcacgtggtatcgagtatactagatacgctgacgacatgattttttccgggggccccgacacccctaagatccttaaggcagtgcgggcctttgtcgcagaggaaggcttcacgcttaacgaaaagaagactagaatcctccggagaggtcgtcgccaggaggtgtgtggactggtggtaaatgagagagtaggcataccacggctctggaggaggcgattacgggccgaggttcaccgacttgccacaggtcgcgatggggcaaaggccgctcctgctcgtttaagaggggaactggccttcctgcaatgctttcacccagaagaggcaggcaagcacgcccgcaaactgctggctctgctaaaacagtga

SEQ ID NO: 13960 - RNA, 1077 nt, unidentified
  source 1..1077: mol_type = other RNA; note = synthetic construct
atgggattgctggactttctgagaaatctgcttagccctcagagaggctcagacgagtcaccagcgctcaaccactccgacacaagacccaagaccgccgacgcctctccaagtcaggctgaagcccctgctacccccgcagtacgtatccgtagacggaggccactcctccccagacagttgggttcgccccctacgtttcgccgcctgatggcagctcttcgcttaagtcatgtgcgcgtgagacgggtcatgcacagtaaagcgccatatcatacctttaccatcgccaagcacaatgggagcctgcgtgatattgctgcgccctgtcgatctcttaggcacatccagaggcgcatactaagacggatcgtagagcctctggatacccacttggccgtccacgggtttaggcgtggtcgctgctccttaactggggcacggcgacatgtcggcaaggaagccgtcctggcgatggacctgcaggactttttcccatccattactagccagcgggtgtacgggttgttccgtaagttaggctggcctccgaacctagcctctgttctgaccagactctccacgtggcagggccgactccctcaaggagctccaacaagcccagccttggcaaacctgatcgctcgccggatggacaggagacttgccggtctagctcgccacaggggcatttattatactagatacgccgatgacctcactttcagcggacctgctgacgcagtgcgatccgccataccggccatacggatgatcgtgaaagaggaaggcttccggcccgccgaacataaaacccggctcatgagatgcggaaggcgccaggtcgtgacaggactggtggttaatcggcaggtgtctgttcccagagattaccgacgcagggttagggctgcactgcacgggatccgaactggcaggaccacgttcgcaacacccgctgatcgggccacaactcttcgggagctggaggggcatgtgcaatacattaggtcaattaggccggagcatggagatcctctggcagctgatctgtatgcagccgaaacaggccaatga

SEQ ID NO: 13961 - RNA, 1044 nt, unidentified
  source 1..1044: mol_type = other RNA; note = synthetic construct
atgggcttcctcgacttccttagagacttattttcgccaaaatcatctcctggcgagcaccctagttctgctcggccaggagaacgtacccgacataagaagggagttcgcagtgcccccctactcccggagtcattaggggctaggcctacttttcactgcctggtcgggacacttggactgaaccatgttcgggttaggcgcgtcatgcactccccacacgcctatcacactttcactattgctaagcgggggggcaaactgagggaaatagccgccccctgtcgctccctcaagcacattcagcgcaggatattgcaccgtatcgtggaaccccttgacaggcacgctgccgtgcatggattcaggcgtagacggtgctccctgacaggggctcgaaggcatgtgggcaaagaggccgtgctcgccatggatctccaggatttttttcccagcattacgtctcagagggtgtacggcctgtttcgaaagctgggttggcctcaaaatctggcatctgctctgacaagactgactacctggcaaggcaggttgccccaaggagcccctacatcccccgcactggccaacttgatcgcacgacggatggatagacgcttggctggcctgggacgacatcggggtatctactacacccgctatgctgacgatctggccttcagcggtccagcggaggttgtccgtagcgccattccgagtattcgcacaatcatccaggaggagggtttccgcctggcggagcataaaactagattgatgagacggggacggcggcaggtagtaaccgggttagtggtgaacgagcaggtgtcagtgccacgggactaccggaggcgagtcagagcagcactccacaatctgcgcaccggcagaaccacgtttgctgcagtcgcggaaagggctgccgcacttagagaacttgagggccacgtgcagtatatcagaagcatccgcagcgaacatgccaagcatctagaagcagacctgtatgccgccgcggatgggatacagagatgtctctga

SEQ ID NO: 13962 - RNA, 1113 nt, unidentified
  source 1..1113: mol_type = other RNA; note = synthetic construct
atggggtttctggactggtttctgcggaagatcatcaagcccaaagtcctggatggatgggccagagcacgaaggaggggacagatcaatgcactccgtaagaagcgtgaacgagcgagagcaatttgcatgttgccccaggacggacggcttccaacgaggaaggcccgcaaccccatgaccgggaggaccatcgaggttgaatacgacgacggcctgaaaggcatagctaaagccttgggtctgaaaccgtctcgggttgctaagctgagcttcagtccaaagaagttatacactactttcacccgccctaaacccgcaggaggcgaacggacaatccatgctcccgtccgatcattgaagtatgtgcagcgaagaatcttagacagaattctcaattgggtcgatttgccagactgtgtgcacggttttagacgctacaggtcgctcgccactggtgctgctgaacatgtggggaaagagatggtgttgaggatggatatcgaggattttttcccttcaattcacttcggccgagttctcgggctattccgtagcctgcagttcagtacaaaacatgcctttattcttgcgcgcctcactaccgcggatggggtcttacctcagggcgcacccacatctcctgcaattgcaaatgccgtttgccgccgactagatagacgcctcatgggggctgctcagaagcaggggataagctatacccggtatgccgacgacatgaccttctctggcccagctgaagaggtgaagaggctggtcccgtttgtgaggaaagtcgttggtgaggagggcttcacagtagccgacaagaaagtgcgccttatgagacgggggcgcagacagattgtgacaggagtggtggtgaacgataagctgtccgtacctcgttattacagacggtggctgcgggccaccatccaccatctgagaactaggggagccacgccagatggactgacagctgcgcaacttcggagctccctgctgtcccacgcccactacataaagatggtgaacgccgaccagggcaatcgcctactcgccgatcttcgggaggtactgggccaacaaggtggcaaaggaaacaggtga

SEQ ID NO: 13963 - RNA, 909 nt, unidentified
  source 1..909: mol_type = other RNA; note = synthetic construct
atggggattctagactggttggcgagattgctgcgcggtggcggtgaaagtccttttgccgccggaaggaagggcccgaggttaggtctgaaactcaacaggctgtggcatctggcccgcaacgtggagggccactactccgagtttgatctagaaatgcccggcgggcgtaaacggcgaattgaggctcccgatgggaagcttcgctgggtacagagaaagatcctgcgaaatgtgctggatcggcaggagcaggggccttgctgccatggtttcagaaagaagcatagcatcgcaacaaacgcagccggacacgtggggaaggagatggtgttggctgtggatatagaggactttttcccttctatcacattccccagggtatacggactgttcaagtcaatgggctttgacaggggaagaagcgctctgcttgcaaagctgacaactcgtaacggcacacttccacaaggggcccctacctccccagccatcgctaatctgctgtgtcggcgcctggacagaagattaggaggcctcgcggctaaagccagaatgacgtacaccaggtatgcagacgacttaaccttcagtggcagcgccgatgccgccaagtatcttcggttgatagtcgaaatcgtgaaagaagaaggctttgcactcaatccagccaaaactcgaatgatgcggcggaaccgcaggcaagaggttaccggactggttgtcaatgataaagtgggcctcccccgcgagtggaaaagaaatctcagggctgctctccaccacctccgtactggtcgaccagcgtcagacggaccggaaaaaattcatgggaagctggcattcctaaagatggttcaccccgaacagtatgtccgggagcttgctgcactgaaagccttgtcttga

SEQ ID NO: 13964 - RNA, 1485 nt, unidentified
  source 1..1485: mol_type = other RNA; note = synthetic construct
atgagcgacctggagcagctgctcgtaggcctggacgctgaaagcgccagcggacgaatgcacgccattcagagaagcactgcttatgacaagcccacacgatctgcctttctgttaaaggccttagaacactgggacagaaaggtccgggagaaatctgccaaaatcttgctcaagatcggcggggacttagagctggccgcagtgtgtagcgcagtggactccagaaaagtgcctctcctgcgccttattccatggctggcacgccggaatcatgccctgactactaggacaatctataacctgacacaacattcacacaaggtgatctccgaggctgcatccaaatacttgattaaaatggatacgaccgaggctctgttttatagatggagtaagcagagtaggattccaaaaaaactcgctgcccagatcgaagcgtgtgcgtgtgaacgggtcgcttccgtcttgtctgacattcccgtgtccgtgatccatacgcttcgcgggaagtttcttaggtatccactcctgaagaaatactaccacgacaagtattcggatagccggccccaatcatcaaaagaaaccgtcagtccgaaggctcctaaagttcagagtgaatacgtgcaaagctggaataagctcggcattgactggaggattgcagggtggattgtgcggaactggtcagatttggatgatgtgggctacttcgagttcaagatccctaaaaaaaacggtaccgagcggatcatcagcgcaccagtgactcccctaaagattgcccagcgtgttgtcctggacaaaatactgtctaccgtcccacaacacgatgcttgccatggcttccgcaagaatttctcgatcattacaaatgctacaaagcacacggggaaggatgtcgttattcgcatcgatctaaaggatttttttcctagcatcaaacccgccaggatcgctggaattttccgatccctgggattttcagacttcgagataaggttcctcacccgcgttaccacccgaggtggtggattacctcagggcgccccctctagtccttgccttgccaatatcgtagcgaggaggcttgatagtcgcctgaatggtctagcggcctccgtggggggaacttacactagatacgcagatgacttgataatttcaggccacaaaaacgtggtgtctatcctgccggccgttaaatccataatacaggaagaagacttcgggatcgccagtgagaagctgagaatagcaagaaagggagctcagcagaaggtaaccggactcatcgttaaccagtgcgtaaacgccccaagagagttgcggcgtaagctgcgggcggtgtttcataagcagtccaaaggcgaggtgccctactggggcaacaagccgatgagcgagtcacaaatgcgtgggtatcaggcattcctctcttctatcgagaagtccaagacagaccagcacgaaaaactttga

SEQ ID NO: 13965 - RNA, 1356 nt, unidentified
  source 1..1356: mol_type = other RNA; note = synthetic construct
atgacaaagaaagccaataacaacgcctcagatatgttcggagctgtcgccgagaaaaggtattctgccgtgaaacgggtttctaagttacccgtcgaagaggcgttgcccatacttaaaaagggtctgaaacactgggaccggaagcttaggaacatgtgtagccgcgagatcgtgaggaagttgggagggaaagcggcttcaatcgtgttgccgctatatgttaaaggcctgcttagtcgatcgtcaagttacgaacagctcctccgaaaggaagacgctacgctgaccgggtacgtgctcagaagatcccgccgaaaagattctcttggccaagtctgcaaaggtctgtactctcagactaagcactataagaggattcaggaaaaacagactaagcgtgatcaggagttactggcagacaacgaccgggcgggccaaacctgggttgctcaaaagatttcaccctgggatctgctgaaggagagattcagcatccttaaggaactcaaagagaacacagcccagttcgtgttaggacactggtatcgaaataataccttcgatgatctctacgacacttttgaaattccaaagagatccggcggcaagcgcaagattgaggcccccaaacccgctttgaagctggcacagaaggccatccttgagaaactgacaagtgacgtgcgtttgcacgacagctgtcacggatttcggagggcacacagcatcgtgtctaatgcaaagccacatgtcggcaaagccgtcgtagtcaacctcgacatcaaggactttttccctaccatatccgcagccagagtatttgggatatacagaagcttcggttacaaaaatgaggaagcttcctttctgactgcattgtcctcgtttaatggacgactgccacagggagcgccaacaagccctatgctagctaatatcgcctgcattaggctagattaccgcctgtccggactctccaacacaatcggcgccgactattctcggtatgccgatgacctgaccattagcgggcctgagtctattaccaaatacattgctctcatcaggaagattgtggaggaggaagggttcgctctggcactccctaagctgcgcatccatagaagaggcgcccgccaagaggtgaccggtctgacagtgaacgatcgggtttccgtgccccgggttatccgcaggcgtatacgggcagctctgcatcatgtgaaccagggcaaagaggccacttggaagggcgaaccgatgagtctcgaatcactgacggggcatatcaactttattaagagtgtacaccctgatctggggcaggccctgttcaatagcttaccacagtga

SEQ ID NO: 13966 - RNA, 1023 nt, unidentified
  source 1..1023: mol_type = other RNA; note = synthetic construct
atggacaagcgctccagcgctgccgaccggaaaggcaacgatttcgtggagcccaacggggacctggtaaagagcgccgggaatggatggctgtttgacttatctagggaactcgatatcagttgtcgagatttgggttggttacacggaacgtggggtacttggaaccagtggtataagacctatacagtaccgaagaaaaccgagggttttagggtgatttgcgcccctcagggattgctgcttgctgtccagagaaagatcaacgatgtcattctcaaagaagtcgtgctatctagctgttgccacgggttcgtcaaggaaagaagtatcatcactaatgctgcagctcatgttcagaaggaagtgctcctgagtctcgacatcaaggactttttctctacaatcactgcaaaccgggtcttcggcgtatttaaaagccttggccgctcccctgaggaggcacgttttctcactagactgtgtacctataatgggtgcctcccacagggtgcgccttcatcccctgccattgcaaaccgggcttgtaatcatatggacaaacggcttgccaagttggccgaatatcaccgcgccgcttattcccgatacgctgatgatctgacattttctggcgataagccagtgctaaggctgctgccattaataaaggccatagtggcggaagagggcttcgccattgccgagcacaaaacccgcgtggcaaaacaaaatcagcgacaagtggttaccggactgaccgtgaattccgagattaaagtgaggcggccagagaaacgcagaataagggcgatcctccatcatgctgcctgcagacgtagcacaacgtcacaccaagttcccattggagttcaggaaatcaggggctactacagcttcctgaaaaatgtggaaccggagtacgcagcaaagctgtacctggacttgcacgagaagtacctgatgctggaccttgcccccgagacaaaccccttctggcttagtcagcggtcatcgagatga

SEQ ID NO: 13967 - RNA, 975 nt, unidentified
  source 1..975: mol_type = other RNA; note = synthetic construct
atgatcgagattttggaatatattctggcccctatcggagggctcatcgtcctggtggtgatagccatatccatctttaggtttactcgggccacaaacggtcacttctggcattggctcagggccatgctcggctggggcaaagatatccgagaagtcgcggctcgcttgggtatgacagaacaggaacttcggaatgtgagtccgtcctttcgcgaggtgttcgtgcccaagaagcggggaggacagcgacgtttgctggtgccagatgccgatcttaaaagcttacagaggaggatcttgcatagactcttaaagaagctgagagcacaccctgctgcacatggctttgagaggggcagaagcatcgttaccaacgccctgccacacaaagggcagagggtcgttataaagatcgacctggtggactttttcactggaacaaaggccaaccgaattgaacagtattttaggcgaattgggtggaatgccgacgtagctgctctactgaccagactgtgcaccgcagaggggagtctcccccaaggtgctcccacaagccctcgtctctccaatctggtaaacttcaatatggactcacgcattgcaagggtcgtgcagcaacgtaacgggcagtacaccaggtatgcggatgacataactatctctttccctgaggattacccctcacggattcgaggcgtaattcagcgcgttaagagaattgtgaaacagttcggctaccgtatccacgtgcgcaagaaactacagattctgagatctcaccagcagcagagagtgacggggctggtcgttaatcggaaagtccagcttccacggaaggttcgccgctggcttcgcgctgtgcaacatcggttaaagacccggggctcttcgactctgacggcaaaacaactggccggctggagaggaatgcagatcatgatcgagcagcaacggcaaagaaccggatga

SEQ ID NO: 13968 - RNA, 975 nt, unidentified
  source 1..975: mol_type = other RNA; note = synthetic construct
atgatcgagctgttcgagtacatcgccgcctccgctggggcacttgtgattctcttgactgtcgcagttactgcactgcggttcaattacgccatcaacggtcggtattggcactggctgcgcgccctatttggctggggaaaggacatacgcgaactggcgggccggctaggaatgacagaacaggagctgcgcaatacaactccctcgtttcgcgaggttttcattcctaaaaagcgaggcgggcaaagaaggctcctggtgccagatgcgggattgaagacgttgcagcggagaatccttcaccgcgtcttaaagaagctgcgtgctcatcctgcagcacatgggttcgaaagggggcgttctatagtgactaatgcgctgccccataggggacagcgggttgtcatcaagattgatgtcgtgaactactttaccagtaccaccgctaaaagaatcgaagattactttcggaggattggttggaacgctgacgtggccgccctgctgacaagaatttgtacggcagaaggaggcttaccccaaggcgcccccaccagtcctaggcttagcaacctcgtgaactataacatggacagccggatagcccgagctgtccaatcccgtaagggccagtataccaggtacgccgacgatataacaatttctttccctgagaatcacccaaaacaggtgagaggtattatccagttagtgaaacgcctcctgagacagtgcggctatagaattcacgtgcggaaaaagctgcgaatcctccgatcccatcagcagcagagagtaactggtctggtcgtgaataggaaagttcagcttccgcgaaagatcagacggtggttgagggccgtggagcaccgtatgaaaaccaagggctcagccagcatcacaccagtacaactcgctggctggcgcggggtacaagctatgatcgacaggcagcgcgaggggtcaggatga

SEQ ID NO: 13969 - RNA, 993 nt, unidentified
  source 1..993: mol_type = other RNA; note = synthetic construct
atgaataccctgttcgcagatgcgaatgtagttctgctctggggccttgctctcggaggcggattcgtggtcttggtggccagcctgtgggtgtcttacagagtggtgagggctacaaacgcacggcctctagagtggctccgagttcggcttggtcgcggcaaggacctcacgactctagccgccagattgggggtgagcgttcaagagctgcagggggtagagctgttctaccgcgaaagcctcatccccaagaaaaggggcggtcagcgacgcctgcttatccctgatcagccactgaaggctatgcagagacgggtcctccgcaggcttctcagaaggctgagagcacatccggcagcgcatggttttgagcaggggaaatccatagtgaccaacgctctgccacacgttggacagtgcgtggtgattaaaatggacctggtggattttttccctagtactaccgcccagagattggatgcctatttcagacgcgttggatggaacgctcaggccgctgctctgcttgtgaggctcgtcacgcatgccggggtgttaccgcaaggggctcccacaagtcccagattatctaatctggtcaactttaacctggacgcgcgtatcgcccggtttgtggcaaagaggaagggcgcatatacacgttacgccgacgacattacaatctcctttcccaaggatcatccacggaaggtcaggggaactattcagaaggtaaaacggatcgtccgcgatttcggatatcgcatccacgtccgtggcaaactgcagattttacggaagcaccagcaacagcgagttaccggcctcgtagtgaatgccagagcacagctgcctaggaagctgcgacactggctacgagccgtggaacacaggcttcggactcgcggtgaagcctcactgtcaccacaacaattggccgggtggcgggctttgcagggcatgatagcaaaacaggcgaaaaccgactga

SEQ ID NO: 13970 - RNA, 1086 nt, unidentified
  source 1..1086: mol_type = other RNA; note = synthetic construct
atgaggcctgtcagacccgtccgtccgagagaaccaaaggcaccctgggcctttgctccagctaagcagggggtggctggtcccgagtatagtgggccagtattcttagtaaattcgctattcacgtttcctagcaggctctttccccggcgtaggagactggcctctctggtgaaaaagtggctcaggtccgtgtggagactgttccgcgttaaaaaacggaccgccgatgaattggcacgcaggttagatgtcagcctcgcagaattactggattggacaccctcctacagagagacaatcatttcaaagaagcgcggaggcactcgccgactcctgattcctgatgctaagttgaaggccctccagcggcggatcttgcacaaagtcctgagaaggctccgcgtgcatcccgcagcaaagggctttgaaagagggcagagcattgtggataatgctggcccccatgtcggccggtctgtggttataaagatggacatcgttgacttctttccaagctgtaaagccgaggaggtgaccgcgtacttccgaaagatagggtgggacgaagcggcgggcgtgatccttaccaaactgtgcacgcatgagggacggctgccacaaggtgccccaacttcacctcggctgtctaatctgatcaactggccattggacgcgcgcattgccaggtgggtggcttatagaaaaggagcctatacacgatacgccgatgacataacaattagtttccctaaagactaccccaggaaagttcgtggggtgatccagcaggttcgaagggccgcccgaaaacttgggtttcaaattcacgagcagggcaagttgcgcatcctgaggcaccatcagcagcagcgtgtaaccggtcttgtggtcaacgagaagcttaacctgccacggagactacgccggcttctcagagctgtggtgcaccacctgcagactggaaagcccgcttccatgaccgccgagcaactggcaggttggcaagctctggccaacatggtcgcaaagggcgcagccaaatatcctgcaccggcttcccctaagtcacctggaaaaccgtga

SEQ ID NO: 13971 - RNA, 1056 nt, unidentified
  source 1..1056: mol_type = other RNA; note = synthetic construct
atgatgcagagacatgtgtttgcacatgccgagcagggagggccaattcccggcaatccagctaaagggttcctgtggttatttgctattatctttgctgttctgaccgtggtggtcatctgtgtggctattgtgctgtggctgcagcgcttagccctgctccctaagccacatgaaacgcataggaccgaccgaaggaggacccggcttggaagaggcaaggatctcgcggaacttgcacggcgtctggacacctctgcacagaaactacaaacagcaaatcgccgataccatcggttcactacggctaagaaacgaggtggcaccagggtcttgcatgcccccaatcccgagctcaagcacctccaaagactgatccacagacggctcctgagaaagcttcaggtccactggtgcgcaactggattcgaacctggcgtgagtatcgcgcataacgcagcttttcacgccgggcaggccgtcgtgatcaagctggacctgaaggatttcttccccaacactaccgccgaacgtgttgagcactattttcggaggattggctgggatgccgagtccgctgctctgcttactgaactgtgcacccacgagggtggattaccgcagggtgcccctacaagccctaggttgagcaacttgataaaccacgtaatggacgcgcaaatactgcggtatgtggaggcccaccacggcacctacactagatacgccgacgatatcacagtctcttatcccgaggattggccgaagtatgtgagaggaacaattcagcacgttcgccgaacagccaaacgccacggatacaccgtccatacaagggggaaactcagggttgtgcggaggcatcagcagcagagagtgactggcttggtagtgaatgaccgggtcaatctaccacgcgaaaaaagacgctggctgcgcgcagttgagcaccgactgaagacgcaggggcgtgcttccttgacagcccaagagctcgaagggtggaaagcactttcacaaatggtagatcgccacgccaaccctgaggcgggctga

SEQ ID NO: 13972 - RNA, 1047 nt, unidentified
  source 1..1047: mol_type = other RNA; note = synthetic construct
atggggacccagagtatcgaactcctcgctgggatcgatccactggccaaggtctgctttgtctcctgtggcgtaccactgattacagtggtggtaattttattggttggctcgaagcgcggctggttcaagccctataaggaaactcataaggtcgagcgaaaaagggcagctaagggtctggggaaagacatagaggctttggggcataggctccagactcctcccgacgagcttagaaattttgaacctaaataccgcctggcatccatttctaagaagcgtggcggccgtagacggctggatatccctgatcacaagaccaaaaccctgcagagaactattctaaggaagctcctgcgcaacctaaaaacacactcttgtgccatggggtttgacccgggcatctcaatcgcccataatgcagccgttcacaccggccaggcggtggttattaaattggacatcaaggacttcttccccgcaaccacaaaagagagagtcgagcagtacttccgccgagtgggctgggatggagaatgcgccgcgttgttaacgggactggtcacacataatgacggtctgccgcagggagccccaacttcacctcgactcagcaatctggtgaactatgtccttgactgtcaaatacagcggtacgtgctgaagcataagggaacttacacccggtatgccgacgatattacggtgagctatcccgaggactggccaaagtacgttagggggactgtgcaaaaagtgcggagagtatgcaggcggcacggctacaccgtacacacacgcaaaaaactgagaatcgtgagacgtcaccaacaacagcgggtcacgggtttagttgtgaacgagaaagtgcagctcccaagagagaagaggaggtggctgcgagctgtggaacaccggctttccaccacaggagaggccagtctcacagaagaacagcttgctggttgggaagcactgcagcagatgatagatcaacaggctcgccccgggaggggaagcatgaacgagggagatcctgagtga

SEQ ID NO: 13973 - RNA, 1017 nt, unidentified
  source 1..1017: mol_type = other RNA; note = synthetic construct
atggggaacttcggacgcaagcgtaacgccgatatctttacgtggctcgtgctgtgtttgcttgctatcatactgattttcgcattcccaatctttatcctgatcgaattgatcaactgcttcttccccgatcgcctggctaagaagcggtacagacatgtattcagacatatctgtggcatgggattaaagtcagatgagctggcccgtagactcggcatgaccgtggagcagatacaggctacccctcaggactatacaacacggaaaattcccaagaggtctggagatcaaagagaactcaatattcccaacgagcagcttaagagcctccagcgctgtattctcaaagggctgctatcaaagctgaagactcatccggcagcgatgggtttcgaagaagggtatagcattgctcataatgcgatgctgcatacacagcaagccgtggttattaagatggacattaaggacttctttcctagtatcaccgccgccacgatcgagttttactttcgggagataggctggaacaagcgggcagcgttcttactaagtgagctgtgcacccacgcttaccaactccctcagggcgcaccaacctccccaaaactctccaatcttgtcaattacatgatggactaccaaatagagcaagccgtgaagcactatcacgggacttatactaggtatgccgatgacatcacaatatcttttccgaaggattaccccaaacacgtaaggggcatcatgcagaaggttcgatgcattacaaaatttcacggctacgaactgaatcacaaaaaaacccatatcctgcgacagcaccagcagcagagggttactggactggtggtgaatgacaaagtcaaccttcctcgagagaaaaggcgctggttgcgggccgtcgagcacagattgcagacccagggtaaagcctccttaacacaggaacagctggacggttataaggctctgcaacaaatgattgccagccagactcagccaaaagcatga

SEQ ID NO: 13974 - RNA, 1116 nt, unidentified
  source 1..1116: mol_type = other RNA; note = synthetic construct
atgttcaggagatccggccggttcgtgacagcctccgactctagggttcgcgtgcgccagttcagagcggaaatccccgacaccaaacaggatgtaactgggactggacttccagtgccagtctttccgagtggcggggtgatgctggcatttaacctgctgtcccagttggtaagcttcgccctcgtcgtagcttgtttgttcggcgtgggcgtctgcctgcatataagatatcggcgggtaaccaatagcaatctgcgtcactggttacgggcaagacgtgggcagggattggggatcgacgagctggccaggaggctcgatgtctcagaggacgaattgcgcagtgttgacgtgggttaccgggaggcatttatctccaagcgaagtggggggtcacgccgcttgctcattcccaattcagaactcaagcgcctgcagcgcactattctcagaaggctcctgggtcggctacgtactcatgatgcagtgaccggtttcgagcgcggtctgagcatagtcgagaatgccgctcctcacgtgggccaggcagttgtcattaaacttgatgtcaccgatttttttccatccacaagagccgaccggatcgatgcctactttcgaagagttggctgggacgctgaatgtgccgctctcctgacaagggtgaccacgcacgaggacggacttcctcagggggctccgacatctcctcgactgagctcgcttgtgaacttcggacttgatagagctatcgagcggtttgtgtgcgataggaggaggggcgtttataccaggtatgcagatgacctgaccatttctttccccaaggattaccctcgaagaataagagtggttgtccaattcattgcccgaaggcttcgatgcgacggatacgctctgaatcgaagcaagatccgcattctgaggcagcaccaacagcagcgtgttacgggcctcgtggtcaacgactgtgtgaacgtgccaagacacatccggcgcaagttacgtgcggtggaacatcgcctaaacacaggacggtctgcgactatgacacgggagcaactggccggctggaaagccttactgcaaatggtggaacagagacggccctga

SEQ ID NO: 13975 - RNA, 1011 nt, unidentified
  source 1..1011: mol_type = other RNA; note = synthetic construct
atgatagatgccgttttcaatggcattgagatagccgccaaagcttgcctgtcaatcactggggttatctttttggcagtgggagtattaatcgcttattttctctggaatctcagcacattgaagagagcacgtccggccaaccttaagcactggaaccgcgtgcggagaggagatgggttcggtgtggaagaactggctcgcagacttggcgtgacctccgatgagctggccgctgtctctcccaattacacagagaggttcattgaaaagaggagcggaggcaccagacgcctgctggttccctctcctgagctgaaagaactacagcaaaagatcctcaggcgtctgttagcacgattgtcagtgcatcctgcagccaccggttttgagcccgggacttcgatcgtacacaatgcggctcagcacgtggaccaggcggtcgtagtctgtatggacgtgtctgacttctttcctcagactagtgaagccagagtgaccgcctacttccagcgcattggctggaatcgggagacggccgagctgctcaccaggcttacgacttgggagggcggactaccacagggggcaccaaccagccctaggctctccaacttggtgaaccatgttctcgatgccaggattgagcgctttgtcgaatgcaggaaggggaattatacacggtacgctgacgacatctccgtcagctttccaaaagattacccaaagagggttcgtggcaccgtccaggtagtcggccgccatctgaaagccttcggctatcagctgaacgctaaaaagactagaattctgcggcagcaccaacagcagaaagtgacaggtctggttgtgaacgatcgggtgaacgtgccccgaaatatccgccgaaagcttagagcagtggaacaccggctgaataccggacaacgggcgacaatgacacgagagcagttcaacgggtggaaggcattactcgctatggtggaacaacaaagagacggaagtcagtga

SEQ ID NO: 13976 - RNA, 1119 nt, unidentified
  source 1..1119: mol_type = other RNA; note = synthetic construct
atggccgagctcaaaaagacggaacccaagaagaccagcaaatggagcggctgcctggcaattgccctcggactggccgtcgttggatggtgcctttatagcattgtgaggggtgttgtgggactgtttcatatggggcccgtgacttttggggtggttgcaggcgtgatcggactcgtgatcgcctggtttgtggctaggtcctggtggcgaaagggaggacgcaacgccgtgcgtagagctttctggatagctcccggtgtggctgagttggccagacgcttagatgtaacgcccgaaagacttcggaccttttctccagtctaccgcgaggtacgaatccctaaacggagtggcggcgttcgagtgttgcatgtgccggacgctaacaccaagtcgttacagcgtaagatcttgcaccgcttgctggcccggctgaagtcacaccctgcagcctatggcttcgaagccggtaggtccatagcccatcacgcggcccagcataccaaacgggcgattgtcctacacttcgacgtggttgacttcttcccgagcaccagagccgagaggatcgaaaggatgtttttaagactggggtggaatagggaggctgcgctggtgctcacaaaactgactacccacaagggcggactgccacaaggagctcccacatcccctcgccttagtaatcttgtcaatgcaggcttggatcgcgcactcacaaagcgggtgggcgaactgaggggtagatactcacgatatgccgatgacatttccgtctcattccctaaggaccgtcgcgggtctgtggagcgaacaaaggccagagtaatgcacgagctgtgtctgcgcgggtacgagatgcacgtccgcaaaaagctttctgtacggcgtgcccatcagagacaggtcgtcactggcctcgttgtgaacgaaaaggtcgctctgcctcggcacctcaggcggaaactgagggcagctcggcaccatctggcaacagggaggccagccacctggactgacgagcagctaagagggtgggcagcatttgaaaaaatggtgagagatcagggtgcgcccccaccacaagatggggatggcactacaccaaaagcttga

SEQ ID NO: 13977 - RNA, 1038 nt, unidentified
  source 1..1038: mol_type = other RNA; note = synthetic construct
atgacagtgggctgctggtttgccctcctcgtaatgttgggctcagtcgtcggtgccatcctcgtgaccccctggtctttagctgctactcctgccgctgttgcactcctgctgacctttcacggactgcgccacaggtatggcgcctacccatggcggagacttcgtgcccatcttggctacggacacgggattgacgagctggctaggcgtcttgatagacccgctgctgaacttcgcagtgccgctccggtctatcgagccgtggacattcccaaacggagaggtggcactagacgtttgcacgtgcctgatgcggccactaaggccctgcagcgaggcatcctgcaccgacttctgaagcggctaagggcacatggagcggcccatgcctacgaacgcggaaggtccatcgccacgaacgccgcacagcatgtgggcagagcagtggtgctcaagatggacgtcgtcgatttctttgcttcgacctctgcggccagggtcgagaggtatttcaggagaatcgggtggaatcgtgaggcagcagctttattaacccgcctgactactcacgagggagggctaccccaaggtgcgccaacatcacctagactggccaatttggtgaacaggcacttcgatgtgctcattgaccgcacaacccgccgctttcgagggacatacacccggtacgccgatgacttgacaataagcttccccgaggattggccgcggaaaatgcgcggaatggtgcagagagtgagaaaagttgcaaaagctttcggctatagggtacacgggaagccaaagctcggcatctttcgggctcaccagaggcagctggttactgggctggttgtaaaccaacgggtggcactgcctcgagaaacccggaggtggctgcgagccgttaagcatcgggctcgccatggaaaagcaacaatcacctccgcacagattgccggctgggacgcgtacgctgccatgataggtggagccacgagccctgcaccaggtccagcagacagaggggggtga

SEQ ID NO: 13978 - RNA, 1047 nt, unidentified
  source 1..1047: mol_type = other RNA; note = synthetic construct
atgcgcgatactcgaggtcccgtgtggaaacttctaacggctatcggcatggtgctggctcttctcgtgctgattcctctgtttgtcgccgcccttatcctagcactgccatttgtggtgattttaagcggatatagcagataccgcctcgcgaccaacggcagacctataaggtggctgaagctcaagttgggatgggggctaggcgtcagggagttggctcgcaggctggaaatgccagccgatgaattgcggcggtttcagcctgtgtaccgggtggcccggattcctaaacgaagtgggggtcagcggactctgttcattccagatgcagccaccagagccctccagagacggttgcttagaagagtgcttcgtcggctgaaagcccatccagctgcctgcggattcgaggctggacgttcgatagttgacaacgcccgtcctcacgtagggcaagcggtggttatcaggttggacgttgtcgactttttcccgtctacaactgccgctcgcgtcgaaagatactttagagccatcgggtggaatagggcggcggctgaattgctggtacgactgactacccatgagggcgggttaccccagggtgcaccaacatccccccgcctttctaatctcgtgaattacttcctggacgtcaagctcgatagacacgcacaaaggaggcgcggcgcctatacccgatacgcagacgatatcaccatctccttcccccgggatcatggaaggagagctaggggcacagtccagtatgttcggaggctgctgaaggcacatggctatcagctgcaccgcgacaagaaactgtcaattcgccggcgtcaccaacgccaacaggtgacgggtctggtagtgaacgagacagtccagctgcccagagctacccgcaggagactccgagccgttctccatcaccacgagactggacgaccggccacaatgaccttagagcagctccagggctgggccgctttacaggcaatgatcctgaggcaacgggacgggaaccccgacgaagcatcatga

SEQ ID NO: 13979 - RNA, 1056 nt, unidentified
  source 1..1056: mol_type = other RNA; note = synthetic construct
atgccagctaaggcaacgtttcagatggctactggttgttgtctctccgcggcgacggccgttgtgactttcttttggcttctgaattcagatagtcagattagctttgccataatgtccgttctgttggtcgccatttgcgcgaccatgctgtttggctggtggacagcattcttgcagctcactagtaaacacccatggcattggatccgcaccaaatttggttggggattcgagattgaggaactggccaacagactcgggtacagcgtgaacgagctgactgagcaccagccgcagtatgtgagcgcattcatccccaaacggtccggaggcacccgggaacttcgcatccctgataagaagactgctgagatacagaaaaggattttgcaaaggctactgagcaagctgcggtcacatccttcagcctgcgggttcgagacaggaaaatctattgtgcacaacgcactgccacacgtagggaaagctgtggtgattaagctcgacgtgatcgacttcttctcttcgaccacagcttctcgtgtcgaggcctacttctgccgaatcgggtggaaccgaaagagtgccaagctgcttaccaagctcacctgtgatcaggacgctcttcctcagggagcagctactagtccccgcctgtctaatttagtcaattacctacttgatgagcagctggtcagatgcgcaacgaagtaccggggcgagtattcccggtatgcagacgatattacatatagctttcgcaaggacagccccaaaagaatgaggggcataatccagagaacaagacatctcttgaatcggtccggctaccaattaaatactgaaaagcagcgcatcttgcgacaacatcaacgtcagaccgtgacaggactgaacgttaacaccaaagtaagcctgtccaggaagctccgtcgcgaactaagggccgccaggcacagattagaaaatggcaaagaatcaacctggaccgctgaacagctgcaaggttgggccgccctggagcacatgatccaggaacagacaaagtcttga

SEQ ID NO: 13980 - RNA, 1056 nt, unidentified
  source 1..1056: mol_type = other RNA; note = synthetic construct
atgtcagctcggagtactttccaaatgacctctggctgtggttgtacactcatggtcctggcaggcggaatcctgctcgccaatcaagctagcggcgctgtggtgatcttcgtgctttctgtcatttcagtgtttgtattcgctgggtggttaaccgcactgttccagatgacttcaggcaatccgcagcacgcaatacggagctggatgggctggggcttgacagtgtccgaactggccaggcgccttgatctatcagagcagcaactgattaaccatttccctaagtatattgaccgcccaatccccaagcgttccggcggtacccggattctccgtatccctgatgctaccacagccgacattcagaaaaggatactgcagcggttgctgcccttgctcacttcccacagatgcgcaacgggatttgaggccgggcttagcatcgttgacaacgcgctgccacacgttggacaggcggtagtcataaaactggacttggtggacttttttcccaacacgcaccgcgataggctcgagctgtactttaggagaatcggctggggaaaggaggccgcgtccatcttggtgcgcctgacctgcgatgaagagggtttgccacagggggcatgcacttcgccacgactgagcaatcttgtcaatttcttaatggacgagcagctggaccgcctagccaagtctaggaaaggggtgtatacccggtatgccgacgatattaccttttctttccctaaagattacccccagagagtcagaggtatcattttaaagaccaggtggatcgtgcggaggttcggataccaactcaacagcaaaaagcagctgatcctgagacagcatcagagacagtctgtgacgggactaaatgttaacacaaaggcatgtcttcctcgagaactgcgacgccgtctgcgagccgctaggcatagaatgaaaactacagggagcgctacatggactgaagagcagctccaagggtgggccagtctcgaatccatggttgagagtcagacagcctccgagagtgaacggtga

SEQ ID NO: 13981 - RNA, 996 nt, unidentified
  source 1..996: mol_type = other RNA; note = synthetic construct
atgatttcacaacattttatcgccgtgtcaggcagcgatattttccagtgggcttggaagttaatgttgctggtgttcgttatctacataattcgggttctgctggacttgcgtgccctgaagcacgcagggaaccgaaagacagcaaggagagtggccaggggccagggcttagacatggcggagctggcacgacggcttgacatcgccgaaagggatctcgagctttttaagcccgtctaccgcagtgctaccatccctaagcgtaggggaggaaccaggaaactgaggatccccgacccaccaactagggccatgcagaggaggatcttacacagactgctgaagaggctacaagcccacccagcggcatgcgggttcgaacctggtaaaagcatcgtcgacaacgcactcccacatgtgtgtcaaagagtggtgattaaactcgatgtggtcgattttttcaccaataccactgcccctcgggtgcagcggtattttcagtgggtcggctggaatcgcccggctgctgaatggctggcaatggccactacagacgagggcggactacctcagggagctcccacatccccccgactgagcaacctggttaacttctacatggacgtacagttgtccaaattcgctgcccggcgtaagggtgaatacacgagatatgccgatgatattacctttagtttcccgaaagattatccaagacgcgttcggggcgtgattcagtttgcccgcagaatacttcgttctaaaggttatgagctgaatgggcgaaagctcagggccttgcgacgccaccagcagcaaagagtgactgggctcgtcgtaaatgacacggcaaatcttccccgccgcactcggagatggctgagagctgtagagcacagacgccgcacaggaggccagcctaccctctctgacgatcagcttgcggggtggcaggctctccggcatatgataaacacccaacggacaggttga

SEQ ID NO: 13982 - RNA, 1035 nt, unidentified
  source 1..1035: mol_type = other RNA; note = synthetic construct
atggtcagtgtgccctttttaatcggcctgtcagtggctgcagtggttgccgttctgatcgggctgcgcttgggaaggaaaagggactccagtttcgacagtgactggcctaatgactcgcctggaccccttgcgcaggagcgaacagcacaaccgagcgcccagacaaagaagagcaagaagcaaccaggctatgccgccagattcgatctcgcagaattagcccggagattggatgtgccagagcagcagctcttggcggcagagccgacttatcgcattgcaaaaattgcaaaaccctctgggggcaccaggcgccttgaaattccagatgatgacaccaaggccctccagcggtgcatactgcgcagacttttagccacgctcaacgcccaccctctggcttgtggcttcgaagaagataccagcattgtggacgccgccctaccccaccagaatagagcagctgtcatccgtcttgatattagacgatttttcgaatccacttccgccgaccgtgtccaaaattggtttatcgccatcgggtggcaacctggtgctgcggaggtgctgacacggttgacgacaaacgatgggcatctgccacagggtgcgccaacctctcctaggctcagcaacttgattaattcccccctggacgagggacttttgcggctggctaaacagtacggcggggcctacaccaggtacgctgatgacatcactctgagctttaatttcgaccggggacggaagctgagaggcatcatccaggctgctcgacgcatagtgaagtcctatggctacaccctccacggaggcaagaagcggaaagtgctaaggcgacatcaacgccagcaggtcctggggctggttgtcaacgagcaggtggccctgcccagatctaaacgccgttggctgagggccgtacggcataggatagaaaacggtggcgaggcttcacttactgcagctcagctcaaaggttgggagtctttttgctcaatggtacaggaacagagagatgagggatga

SEQ ID NO: 13983 - RNA, 990 nt, unidentified
  source 1..990: mol_type = other RNA; note = synthetic construct
atgttttccgtgcccgtgttgatcggattggctattagtgccgctgccgtcgttctatttggtttagttgcagcaacacgtcgccgggctgcccatggacatgatcgtggcacaccccaccctttaccacccgagcggggaaggtcttccccactacctcagtatgatctgtctgagctgtcccggagattgggcgtaagccgggccgtactcgaacgcttcgagacaggttataggatagccgagatcccaaagcccagggggggggttcgcagactggagatccccaatgaggaaacgaaaaagttacaacgaaccatactgcgaaggttgcttacagcgcttgacgtgcaccctttcgcctgcggtttcgagcctggcacatcaatcgttgatgctgccaccccgcacgaagggagacttgtcgtggtgaaaatggatattcgccggttttttgaatcgaccaccgctgcacggatcctggaatacttccagagaattgggtgggacgccgcttctgcggaggtactgcaaaggctgacgacttataacggacatctccctcaaggggcaccaacctcccctaagctgagcaacctggtcaacgctccgctggacgaagcacttctccgtctggcccggcgacacaatggagcatatagccgctacgcagacgatatcactatgagcttcgatatcagaaggggcagagtggtcagaggactcactcaggtggtcagacggattctgaaatcatacggctacaccatgcacggcggggccaagctgaaaattctgaggcagaaccaacgccagcaggtgctaggcctcgtggtgaatgagaaaactgcgcttccccgcaagactagaaggtggctccgagccgttagacatcacgctcgcgtgggtaggccagtctcactgagtaagcagcagctcgacggctgggaaagttttttgaagatggtggaaacccagagggacgagtga

SEQ ID NO: 13984 - RNA, 1029 nt, unidentified
  source 1..1029: mol_type = other RNA; note = synthetic construct
atgctgaccattcctgtgttaataggcatcgccgtggtgggcgggctggcaattcttattggcatgattgtgggaacaaggcagcagcatcgctcagacgatgatgcctccgcgccaccagctggcaataggcctgctacagaatctccttctgggaatgtgccccagcgcgacacctctactgcgtccctaaccctgacagatttgagtgctcgcatcggcatctcagtggacgatctccaaaatcaccagccggtgtaccgagaggtccgcatcagcaagcctcatggaggagtcagatgtctggagatccccgacgatcggacaaaggaactccagagaacactcttgcatcgtctgtttgcaggaatccgggcccacaactgcgcctgcggtttcgaagccggtacctccatagttaatgccgctgtaccccacgtcaggaagagggtaattgtcaagctggacgtacgtcgctttttcgagagcactaccgcaaaaagagtctccgcttggtttaggagcatagggtgggacgatgaggccactgctgttctgacgcagctcactacgcacaacggccaccttccacaaggtgcaccgaccagcccaagactgagtaacctggtgaacgctcccttggacgagggactgctgaagcttgccacccatcacggaggggactacactagatatgcagatgacattacaatgtccttccacatcaggagcggtcgccggatcagaggaataatccaggccacccgcaggattcttagaagttacgggtataaactgcatgggggcagaaaacagcagatcctgcgacgacaccaacggcagcaagttctcgggttggtggttaacgaccaggccgcacttccacgacatacgaggaggcggttacgggccattcgacatcggacctcgcagggcattgctcctactctcactcccgcacagctagaaggctgggaagcgttccgtaccatggtggagacacaacggcagccctcatctgatcactga

SEQ ID NO: 13985 - RNA, 1023 nt, unidentified
  source 1..1023: mol_type = other RNA; note = synthetic construct
atgtttactgtgccggttctgattggcatcgccgtggccggactgatagccattctgattggaattatcctcggctccagaaaaccctctcctgagcagacagctgagagacaggacgagacagtgtcatctacggatagtgcttctaagtcatccaccagccccgccgctccaccacttaaggctgtgagtggggggctggagatacgagatctggaggaaagaactggcttgagcgccgatgagctccggtcgttgaaacctgagtaccgggtcgtggaaattgccaagcatggggggggtaaaaggcgactggagatccctgacgaaaggaccaaggaaatccaggcaactgttctccgtcgcctgttttccgcgatcagaagtcactcagcagcatgcggcttcgaacgcgctactagcattgtcaacgccgccacgcctcatgtcggtagaagggtggtgattaagctggatatccggcggttcttccaatcaacaacagacgacagagtgcttgcatggtttcagtccgtcggttggtcccaggaagctgcgcagctgctgacccacttgactacatgggacgggcacctaccacaaggagcccccacctctccccgactctctaatctcatcaacgctccgctcgacgaggccttgctgcgattagcagagaaacacaagggcgcctataccaggtatgctgacgacataacctttagcttcaacttcaggtccggaagacgagctagagggatcatccaggcagcgcggcggattctgaggagctttggctacgcaatgcacggaggtcgcaaactgaaagtgctgaggaagaatcagcgccaatcggtattaggactagtcgtaaatgatcgcatagccttaccaagacataagcgccggtggcttcgcgccgttcgtcataggcgggaccagaccggccagtgtagccttagcgatcagcagctccaaggctgggaaagtcttcaacagatgatcgaaaaccagcgtgattga

SEQ ID NO: 13986 - RNA, 942 nt, unidentified
  source 1..942: mol_type = other RNA; note = synthetic construct
atggcgtggatcatcgccgcagctgtcgctatggcaattgctgtcgctttcgttttgctaaagagtacccaggacagcaaatcgaccccaccccgtcggaagccagaaccgttcaccctggcggaccttctggagcggcttcagctgacagaagaagatgcccgccaattagaatccccccagtggaggaaagcctttatacccaaatcttccggaggaacgcgattgcttgagatcccagatgatgtgacactggccctgcagagaaggatcctccacaggctgctgtccgggctgaagtctcaccctgctgcgatcggttttgagaatggcaagtcaatcgttgacgctgcccgccctcactccgggaaacaattcgtgatcaggatagacattgaacgcttttttgaatctacaccggtgacacgggtagaagagtactttcggtttatcggctggactgacgacgccatccgcctgcttactactattaccacttgcgagggccacttaccccaaggtgccgcaacgagtcctagactcagcaatctagtcaacattcgaatggaccacgccctgcagaacgtagcagagagattccacggccattacacacgatatgccgacgatataaccttctcattccatttccgcagtgggaggaaggctaggggcattgtgcaagtcattagacgtatcctccggcaaagcggttatcgtatgaacagcgagaaaacccgaatactgcgggcacatcagcagcagcaggtgatgggactcgtggtcaatgagaaggtggccattcctagatcaagacgcagacagttgagggctgccaggcatcgggttagacagggaaagcccgcaacctttagcccagaacagctccaggggtggactgccttcgagaaaatggtggaggatcaggcatctattgattga

SEQ ID NO: 13987 - RNA, 921 nt, unidentified
  source 1..921: mol_type = other RNA; note = synthetic construct
atgaactcgctgatgattgttgtcgcattcatcgtgtcccttgttgtcgtggccacggggttacttgtacggcgcataattaggaatctgagaaacaggtttacactcgctgatcttgtgaatagacttggtatgacagccgaagaatggagccaactcaaaccacccacttaccgtaccgccatgatacctaaacgcaatgggggacagcggatgctggagattcccgaccctgacaccatggttctgcagcgcagaatcttgagacgggtgttaaagcgtctccgaagtcaccgggccgctataggcttcgaaagtggtaaatccattgtccacgccgcttctccacacatcggccaggccgtggtagtgagggtggacatcgagaactttttccagaccactacagaacgacgagtgggcgagtggtttagggcgatcggatggaaccaggaggctaccgagttcctattgatgatcctcacacataatgggcatctgccgcaaggtgccccaactagccctcgactgagcaacctcgtcaatgcacgcctggatgcaggactcaatcgcatcgctcaatcctacggaggagcctatacgcgctatgccgacgatattacttttagctttcccgtggatcagccaagacagattagggcactgctgcaaatggtgggcaggtatctgaaacaggccggttaccagatgaagaactccaagacaagaattttgagggctcacgcaaggcagtctgttctggggctgacagtaaaccagaaggtcgcgctacctcggtctatgagacggagacttcgtgctatccggcatcagcagtcacaaggcaagcccaccactatgaccgctgcggaattgcacggctggaccgcattcgagcagatgatcgcctcacagaagtga

SEQ ID NO: 13988 - RNA, 909 nt, unidentified
  source 1..909: mol_type = other RNA; note = synthetic construct
atggcatacgttattgctggcattgtagtcgtcatcgcagctgcaggacttgcagccgctatgcgctttcggaaacctcggcgcagctatactctcgggaacctcatcgatttcctagagttgactcccgacgatgcccgagttctcaagcagcctagttacagctcacaccggatccctaagcgcagcgggggatacagactgctggaagtgccagatgagcagacgaagatgttacagaggagactcctcagaagagtgctgtcaaagctgtccgctcacccggcggctgtgggtttcgaaaccgccaaatcgattgtggacgcagcgcggccacataccagcaaaggggtggttattcgcatcgacattactgacttttttcagtccactacgaccgagagggtcgccgcctggtttcgtggtatcggctgggacgccgactccgtagatttcctgacaaaattcgtgtgccacgacggtcatcttccccagggcgctccaacttctccccgtctgtctaacctgattaatgccggaatggatacagtactacaaaggatagccacagagcggggcggcacgtatacacgttatgctgatgacatcaccatcagtttccgacggttgtctggacgacgagccaggggggttgtgcagcatgtgcgcagaacactgaccgcttttggctacagggtcaatactagaaaaacccggatccttaggaaccaccaacagcagacagtgacagggctggtcgttaatcgcaccatatccatccctagaaagcaacgccgaaagctgagagccattaggcacaggatagccaacggacaacccgcgaccatgaccactgatcagttggcaggctgggacgcattcttagccatggtggaacagcagcggtga

SEQ ID NO: 13989 - RNA, 1191 nt, unidentified
  source 1..1191: mol_type = other RNA; note = synthetic construct
atgaacgacggcgctgcctatggccggatggatcgccacgaagtggagccagcccccatacggccatactcagcttggcgggacctgatagcgctgctgctgaccggatgtgggtgtttcagtattttgttcgtactgggtttgaccgccgcaatgtttggtccgcctcttgcccaacgtatcgccccctggctgaccgtacctatcctgttcgctattggaatcaatctcgcccagtggtattttttcaagcgtctcaagcgtgtggacagatactccttattccgagcgaaacacaggatccgcgcagcgagaggcaagggcatggatattgaggagcttgcccgccgatgtgggctcactactcaccttctgcagaaccacgagcccaagtatcgggaggctgagatccccaagagatcaggcggcgtgcgtcggctgcacattcctgacccagctaccatggatctgcagaggacgctcctgcgcaaagtgctcgccaaattgcatgccgatcccgcagcgtgcgggttcgagaaaggaaagggcatcgtggatcacgcagctcctcacgtcgggcgagctgtcgtgataacatgcgacctaaaagacttttttcccagcgtgacagctaagtccgtcgactactattttcggagaatcggctggaatgcagaagccgccgccttgttgactcgcttgacgacccatgccggagaaggcggagaacctgggctgccacagggagctcccacatctccgcgccttagcaatcttctcatgcatggtgttgattacgctctcgccaaatctgccgccagacgaggctttaggtatactagatacgcagacgatcttgcattcagttccgccgaagacgatagccaggccgttcgcgaactgctccagcagattgatagggtggttaaaagagctgggttccggttaaaccctcgaaagacacggattttaaggcagcatcaaaggcagatgatctgcggcctggtcgtgaacgaccggctgaatctgccgaggaaggttagaagggagctaagggcagcactccaccgccgcagaaccggtatgcatgctacatacaccgacgagcaactagccggttgggcaggggtactgactatggtcgcaaggggaccaagagcggaacctggggtgccacggggtgttggatga

SEQ ID NO: 13990 - RNA, 1155 nt, unidentified
  source 1..1155: mol_type = other RNA; note = synthetic construct
atggtgagctctgacactccccctcctgatagcaatgcgtccggccttggctgtgggggaatcgtgtggtccgcactcgcagccgtgttactgctgacgggcctcacagcggttgcagttcttgccgtcagagccttcggggctctggttgctgcccttggagccagtgcactgattgccataggtctaaacttcgcccaatggtactttcttaaaaggctgaaacgcgtggaccggtatagtctcttccgtttggggcatcgatggcgggcttggcgcggtaagggcttcgacatcgaggagttagcacgacgctgcggacttacagcgcaccggctgcaaaaccatcagcccagctaccacactgccacaatccctaagccctctggcggagagcgcaccctgaccataccagatccagccaccatggatctgcagagaactttactgaggagagtgctcgcccgattgcatgccgatccagccgcatgcgggttcgaacggggcaaaggaattgttgatcacgctgctccacatgtagggagggcggtggtcgccacctgcgatttgaaagacttttttccgtcagttacggcaaagtcaatcgattactatttccggagggtgggttggaatgctgaggccgcggcactgttgactagactcaccacatccgaaggcggactgccgcaaggtgctcctaccagccctcgtctctccaatcttctcatgcacggcgtggattatgccctagccaaggccgctggacgcagaggattccgttataccaggtacgccgacgacctggcattttcttcagccgaagatgacggccaggctgtcagagacttgctgagacgcgtcgaggccgtagtaagacgtggcgggtttgaactgaacagcaagaaaacccgagtgctgcgccgccatcagaggcagatgatctgtggcctcgtggtcaacgaccggttgaatctgcccaggaagattcggcgggagctccgagctgcactacacagacggagggtgggcagggaagcaacatacacagctcagcagctggctggatgggcaggggtgctgactatggtcgcgaggggtcccagagcttttcacggggagactccccctgacagtgccccatcttcggcttga

SEQ ID NO: 13991 - RNA, 1725 nt, unidentified
  source 1..1725: mol_type = other RNA; note = synthetic construct
atgaacgatgggataattctagcacttgacggcggggaggccctgtgctttatcagcctggttatcttcatgattgtgttcttcgtggctgtgatacagttcttcaacaagctgaagatcctcgtgcccgacggccagcgcagtatttcaaaggctgagtatttggagcgaaagcgtaaggaagccatcaccaaatatggtaaaccatctgacaagtcacggatttatagactggttcctgagctggagaagttagacccacaatgggatcccagttatgagattgtcagaataccgaagaggagcggaggggtacgggagttgcagataccagatgaacttactaagaaaatccaatacgctctgtaccacaaactcttttcctactacatcgttcaccccgctgcgtgcggcttcgtcaagggtaaatcaattgttgacaacgcacgccagcacgtgggccaggaggtaatcgtgaaacttgatattcgggaattctttcccaatacgaaaaagatgcgcattaacagatactttgtaaccacagggtggaccccagacgctgccgatctcctaaccaagctggtgtgttacgagcaaggacttccgcagggcgcacccacatcaccagtgctgagtaatatcgtgaacaagtctatggacgacaggctgttctctctctctcagagcttcaatgcaaattatactaggtacgcggatgacatcaccttttcaatggagaagtacaacagagagttggtccatgcgttactgcaacgcgtgggcgtgattctccggatatacggatataatctgaaccggaagaaaaaacggattatcaggaggcaccggcgacaggaagtcactggactcgtcgtgaattccaaggtaaacttgagtagaaagagacggaggtggctgcgaagcatccaacaccgcatcaaaaccggtcagaagcttacagtcacaatggccgaatacaggggatggatctcactgctgaacatggttgaccccgagtctaacctgatccatcttcataagcagctcgttaagactgatgcccctgtgttgacgcctatgagcgatcctaatgacaatagtccaacagcagaactccagggttccgatgtcgatcgctcttcccgcgatgagaacaaaacccgtgtgtcctcggaaatgctggatgacaatgccagcgaattacgaacggtggacgaagacaaccctaccagaccatcggggtcccaggacgagacacatactgctgatacatccagtactagggctcccctcaataatgaccagcacgaggaacagtctgagctacccgagctccagtcgtccccggataacagcggggtctttcatgaagaccgacttgaagataaggtgcaggccttgaaagtagccaaaccttacagcactgaagccaaatcactcatcagcgaattcaccaaatcctcttatactatacagctgcagctggagagtagcaaaagaactttctcctttaggctgcctgaaggctatcaaaagggaagaacggtgacaggatccctgtctgatgggaccgaggtggaattgtattttcacgacagccttgctgagacagtcgagaatgccgagtttcctttaaagagcgaggtgacaattgaagttattcaatggaacgcaacctttaaacgtgttgaggccatcgtcaccggcggcctgttccactga

SEQ ID NO: 13992 - RNA, 1098 nt, unidentified
  source 1..1098: mol_type = other RNA; note = synthetic construct
atgcagaacagtaacatgttagtcgcggatggagccggagccgcaatctgtttcggcatcctccttctggttctggccttcatagcctgcgtacggttcttaaatggccatgccaaaaatgtgatacaggacaaggtggtcaatttggatggctttaaaaggctgtccagagttcagaaagctctacttgcccaacgcaagcgcgaggctgccccagaagcatacggttcagtttctgggaccagcaggatctataagctggtcccagagctcgagggtctagggagcgagtggaccccttcgtaccaggtagctcggattccgaagaggagtggaggcttccgagaattgcaaattcccgacagccaaacgaagaaaatccagctggctctgtatcacaaactgttcgcaaactatgagactcacccctccgtctgcgggtttgtgaagggcagatccatcgtggacaacgctagaccacatgtgggacacgaggtggttatcaaactcgacatcaaggaattttttcctaacacataccggataagggttaatcgctacttttctgaaacagggtgggatccggcaggcgccgaccttttgactaagctcgtgtgttatggcatgggactgccccagggtgcccctacttcacccgtgatttctaacatcgtgaacaaggcgatggatattcgactctttgctcttgcagaaaagttcaatgccaattacacacgctatgctgacgacatcaccttcagcctgaaatcctatgaccgcaatgtcgtgcacaggttacttcagcacaccggagtgatcctgcgggattacaagtacacactgaacaagaaaaagaagcgaatcattaggtatcatagacgccagcaagtgacggggctggtagttaatgataaggtatccttgcctcggagacgtcggagatgggtccgtgcaatccagcacagactcaaaaccggcaaagatactaccgtgagcttcagtgagtaccaggggtggatttctctgattaaaatggtggacccagcctcacccctgctcatagtccatcaggagattattcagaacaggatggcgtga

SEQ ID NO: 13993 - RNA, 1734 nt, unidentified
  source 1..1734: mol_type = other RNA; note = synthetic construct
atgcccgcctcggggactgaaacaaatctcattatctggggcttagctgccaccatcgctgccgggtttatactgcttgcgcgttatcgccaacatgtgagcgcaaacgatagaaagcgtggttctaattctgcaggcagccggaaacccagccggtatggacgccaaaacagttacggtaagtccgctcagggcccactgtccgatgtcgacagattgtatagacttatacccgggatccaggaactagtgaaatctggagggacacagtatacaaattcacgcattcctaagcggagtgggggtttccgggacctggacgtgccgaatcaggctacaaagaaggtgcaacacgccttataccacaagttatttagcaaatacaggatccacgagagtgcgtgtggatttgtgaaaggccgctctattgtgcagaatgccctcccacacctgaggcatgaagtagtggtgaaactggatatacgagagttcttccctaatacaagcaggttgcgcattaaccggtacttcaggtccaccggctggacatcaaaggcagcagacttgctcactagtattgtttgctataagcagggcctaccgcaaggagcacctacctcccctgttataagcaacatcgtgaacaagacaatggattggcggtttgctgcattggccgatgcatttggggcccagtacacccgctacgcagacgatataaccttctcccttaagtcttatgatagggggaaagttcatagactcattcaaaacgccggaatggtatgcaggagctacggttacaagttaaacaacaagaaaaagcggatcatcagatctcaccggcgacaggaagtcacgggactcgtcgtgaatgagaagattaacctcccacgatcaaggcgtaggtggctgagagcaatccagcacaggctgagaaacggcctcgaaacgactgtcactaattcagagtacgagggctggatgtcactgctgaagatggttagcccggaatctcccctgctggaatcccaccagcagcttatcctggaaggcatcctgcatcgaaagaaccagagtacactcactgaggagaaaaagcacgcggactcccagcttgagagcgaaacggctcaaagtggtgccgacgtcgtcaccaccgtggagatccgttccgagggctcagatgaccaagccggtaatacctcacccacgtctttggataccaattccgagccagaggccgacgggtcgattcagcttgctgccgataaaagggagcctcagggtgggagtaaaacccatgacacaattgccaatggagttgagtcacaggccgaaagcgatggagtacccgactcgaaaagcgatctgttttatgaagaccgcctgattgatttcgtgcaaagactgaaaaacgcgaagccatactctgccgaggcgcgagaaatcgagaatgactttgccggcgcaaagtacgctaccgtagtggagctggagtcctacaaacggacattctccttcaagctcccagccggctatcagaaggggcgcactgtgagtggaagaatttctgacggcaccgctatccagctatatttcgccgaccagttgagcgatcccattgaagccgctgctttcccttttaaaggggaggttagcatcgaggtcatacagtggaactccactttcaaaagaatcgaagcactggctactggaggcatgtttgactga

SEQ ID NO: 13994 - RNA, 1683 nt, unidentified
  source 1..1683: mol_type = other RNA; note = synthetic construct
atgatcgtacgaggaatcgatgttggcttgtgcgcctgcctcttttctattgctttcactattgtcatcgtccttggtataaagcggctcacctcgccaaagcggaacaggatgaaaaagacaggccagtctaaacgaaggagatcaccttaccgtcccgctaaggcaaaccagactagttcccctaaacatccaaaaagcgatgtggaccgcgtcttcagactcatccccgaatttgagaaactggacccagagtggcgcccttcctacagcatcactcacataccgaagcggagtggcgggaccagacaactgcaagtcccgtgccagaccactcgacagatccaggtggctctatataggaaactgttcgctcggtatgaaactcaccctaaggcgtgtggatttatttccgggaagagtatcgtggataatgctaaaccccacgtaggcaacgatgttatagtgaagcttgacatcaaagaattcttcccatctacatcccgcagacggatccttaattactttcgcactactgggtggaccaacaaggcgagcattttgttgacacagctgttgtgttatgagcaggggcttcctcaaggagcacccaccagccccgtgatttcaaatatcgtaaacaaatccatggaccgacgacttgactccctggccaatgagttcaatgcctcctacacgagatacgccgacgatataaccttcagcatggctgtgtatcacagagataaggttcatgcactcctgcaaagcaccggggcaattctgcggacatatggttacaagctgaacaacaagaagaagaggattatccggggtcacagacgccaggaagttacaggcctcgtggtgaatgacgtcgtgaacttacccagaagcaggaggcgctggctgcgttctgtacagcatcgcatctctaccgggatgcacacctcaatcaccccatcgcagtaccagggatggatcagtttgctgcagatggtgagtcccgactcacccattattgcacggcataaagagctgttggccgccggtatgctgaagtcaaacggtaagtcagggatcaaggaaacaggcggccacgaagaatctgtcttagatgagacaaccgatagaatttccgcagccaattctaattcgcctcagacagacattgccgactctctcaatgagtctgagtcaacgagcatagtgtccagcgacgggggcagcgaatcagagagcctgagcgaaacacctctgaaagaggttacacaggagctggagctagaaagtcaacatgcagtcgggggaagtgctgatgagttatttcacgaaacgaggctgacggataaaatatacgcccttaaagaggttcgtccttatagcgaccaggcgaaacaactgcaggaggagtttaagggctcccagcatactacctccgtgatcctcgagagtcttaagaggtccttcagcttcaagctgccagaaggctaccaaaaaggaaggactctgtctggcttactaccggatggcaccgagatcgagctctatactaccgacatttctgccgaactgtttgatcaggtggacctgccaatccagggagatgccgtgattgaagtcatacagtggaacaacacatttaagcgcgtggaggctattctcctcgacggattgatgtga

SEQ ID NO: 13995 - RNA, 1722 nt, unidentified
  source 1..1722: mol_type = other RNA; note = synthetic construct
atggtgtcttctcctaataccgtgagtggggtagataggctgtcggagatgttgggcatgagcgtgcaggagctggaaaatttctctccgcagtataagcatgccgtgataaaaaaaagaagcgggggcaaccgactgctccagatgccaaatgacgagacaaaacgagtgcaaaggctgctgctggataaattgatcggtaggtacaaaacccacgctagctgttgcggcttctcaaaggggctttccattatcgacaacgctcgtccccacgtgggtcgcgagacagtcattaagctagacatccaggatttcttcccaaataccaccgtcgacaggatccatgaattcttctgtaaaacgggatggacggatgatgccgcagacgtgttgactaagctcgtcgtttttgacgagggactgcctcaaggagcccccacatcacccgcagtgagcaatgttgtcaattgttttatggatctgaggttggacgcactcgcgaaaaagtacgggatgacctacacaaggtatgctgatgacttaactttctccagcgagatatattccaggcgcgacgtccataagattttacgcatcacgggcgttatcttgaagtcctgcggatattctctaaacaagaagaagaagcggattatcagaaaacacaggagacagagtgtgacagggatcgttgtaaatgagcggctgaatatcgcccggcctacacgcagactcctaagatcggtgcaccaccgtcttgaaagcggtggaaattctaccctctccgagaatgaatttaacggctggattagttacctgcacatggtaaaccccaaggatcccttggtcacttccgtgttcggcgagagtgacagcgataaatctaagcgcagaagaagccctaagtacgtcaaacagaacgcctcacagtctgcgtcatcaaattccggccagttcaaccctattgcggatatttctttcaggccaatcaatcggggtgacgttagtaccttgtcccagctgggcctgtcacccaccagcaacgcggtgactcccagcgagtattttagcgcacaactgttttacaacttcggtaaaaacgttaatgtcgtagcccgtcggagaaacctcaaacgcaagacagtgtggaagcatttagctcacgcagtggaacactccctggtcgcctgtcatgatctcatcagtaaggaagacttaagccagcttctatctcagctcaaacagcacagcccaactgccatcccttcagtcggggatgcctataggatgtgcatgggccaaattgactacggacgaattagagttggccttgccgaatgccgacgcagaaagcggaagctccaatccgaccgggggaacgaaattatcacgaaactgaacaacttttccagtacacgcgaggaggccgtactgaaaaccgtttttgggaagcggctcaattgttcgtgcgctgtggaaagtgtgtctataactgcaaacgctgaccttccaccggactacacagagggtcggacagtgcatgctactcttccggaggacccatcaataagcctcaccctgtttacccctgctgcccagaatgataacgtggactcactgtcctctgctcaaaacgtgtttgtgcgtggagcaatccagggcatggatgatgcctccggatgcatagaactgctgactgaagagcttcagctgcgaacctga

SEQ ID NO: 13996 - RNA, 1677 nt, unidentified
  source 1..1677: mol_type = other RNA; note = synthetic construct
atgagcccactgtttgtcgcagacaaccctaggcggatcgcaggtagtctgctaatcatctgtcacgccacagcgattattgactccgggggcggagagtatatggacgaatttctggaagcactgttctctctgcagattgtgtcacttataacggtactgctgatcatactgttctttttccgcaaaaagaactccgacgcaaccagagggagttatcgcacacagcgatcccgtaagacacgcgagcagagaaggcggaagttgaccgttcgggacctggggatgaagctggagatgtccaaatcagaactggtgcgacataacgtgcagtacgagacaacaactatccctaagcggagtggtggcaagcggatcctgcacgtccctgacagagccagcaaacacctccagaggactctgcttaaacaattaatagagagactgccgatccatgatgatgttcacggtttccgaaaaggacggagcatcgtcgataacgccgctgaacatattggccaagaggtgattgtcaagctggacattgtcgatttcttccctgccaccaattctgaaagagttgaaagcgcttttaaaggcgccggctttgataagtcttccgctaagttgctcacacgcctcacctgctatgaaggtgggttgccccaaggagcgcccacctctcctgctctaagcaactacgtgaataaaaacatggatgtgaagctggcggatgccgctttgaggcgatcagccaggtatacccggtatgcagatgacattactttctcatttccagagtattccagggagaagatacacgagctactgatctcaacaggcaagattttgcagtattacgggtaccgcctgaacgaccgtaaaaagcggattattagacagcaccgccagcagcttgtgacgggattagtggtgaacgaaagggtgaacctgccccggaagacacgaagatggctcagggctgttaaacataggatggaaactgggggggaagcaactctaacagcagctgagttccgaggctggctgtcacttttaaaaatggtcgatccagcggcaccccttctgaacttcctagatgggctcaactcgcgtgaggagattatcgataagccgctgcccaaaaatggcgacctgaagaagttagtcggacggcaaagccagaatgtcaaaaccgtggagatccccgtgactacccctggatccgatatcgccgacgacgctttgaccgacaatgcccagcaggaaacccttcgcgattcggaggtcgtgaatgcacgcaatgcaaatactggagtagagaatgtatctctcgtagcgatggtggaggccctcaaccagaccgacaactacacggagagcaggaaaactgccgaactccagctggccggcaaagagtacttgcttgagatctccgccaccagcgttggcagaacttttagttttagcctcccagtagcctaccagaatggccaaacgctcagagctacactgcgcaatgaaggactcgctctcgaattatactgcgacgagcaggtgggttctgaactggcctctatacagttcccaaaaaatttgaaggtccttgttagggttgtgcagtggaacgctatctttaagcgtatcgaggccgtggtgctccaagccagtagatga

SEQ ID NO: 13997 - RNA, 966 nt, unidentified
  source 1..966: mol_type = other RNA; note = synthetic construct
atgagtcgactgcagagggctaatgcagaccgtaaacgggaaaggccgaagctcaccctggctgacttagtggctagactagggatgtcaaaggcggatctggtagagcacgaagtccaataccgcgcaacaactataccaaaacggtccgggggaaagcgagtgttgcacgttccagataggttgacaaaaaccctccagagaaagctgctctatcagatcattggccgacttcccctccacgacaacgtgcatggtttccgaaagggacattccattgtggacaatgccgcaaatcacacgggccaggaggtgatcctgaaactggacattgtggattttttcccctcaacttcatccaagcgcatcgcgggggcatttgaaggggcaggcttcgataagagcacagccgtcctgctcaccgggttcacttgctgggagggaggcctgcctcaaggagcacctacaagtccagccctgtctaattacgtgaacaagaatatggacaagaaacttgctgccgctgcttctggcagaggtgccagatacacccggtatgccgatgacatcaccttcagttttcagaggtactcgcgtgacaacattcaccagctgctgatatctactggaaaaatcctgcagtattatggttacaggctaaacaacaagaagaaacgcatcattaggcggcacagacagcaactggtaacaggactggttgtcaatgatcgggtcaacttgcctagaaagacccgcagatggcttcgttccgttaaacatcgcatggaaactggcggccaagccacgttaagctcagccgagtttcatgggtggctcgccttacttcggatggtcgatcccgactctgctttgctcgagtttgtggacgttcagaatgcgaacaaaaagaatatggccaggagccgcatgaaagattccaacagccagagcgtggtggccggctga

SEQ ID NO: 13998 - RNA, 1554 nt, unidentified
  source 1..1554: mol_type = other RNA; note = synthetic construct
atgctggactccataggcgaggtactgttcagtcccttggtggtgaccgccatcatcgtcctcgtgttgatcctccgatgtttcaaagggcgtggtggacggagggaacttagtattggcgacctggccgataggttgaagatgtccaaaaccaatcttgtgcaacacgacgcccagtatcggaccgcaacaattccaaagagatccggcggcaagcgaattctccacgtgccagatgacgccacaaaacaactacagagaaagctgctgcagcaactcatcgaaaggctagctatccacgattgcgtgcacggatttcgcaagggccactctattgtagacaacgccgcggagcacactggtcaggccgtgattgtaaaactggacatcatcgatttcttcccttccacgaactctgaccgggttaagaatgctttcagaggggctggatttaataaaagcgctgccacccttcttactggattgacatgtcatgagggagggctgccgcaaggagctccatcgtctcctgcactgagcaactacgtgaacaagaatatggacgagaagctcgctgaagcagcaaataaaaggggagccgtgtacacacgctatgccgatgatatcaccttttcgtttgtgacttattctcgccacaatattcataacctcctgatagccaccggaaagattctaagacattacgggtatcgtctgaacaacaaaaagaagcggataatcaggcagcaccgtcagcagctggttacaggcctggtggtgaacgaaagggtgaacctgcctaggaagaccaggcgatggctgagagcagttaagcatcggatggagactgggggtgaagctacactcactaattcagagttccgaggttggctcagcctgctcaagatggtcgatggggactctcccctcctgacttttcttgacagccccaaacctaaggctgaagaaagcgtcacgagaacccgccatattggcgacaatatctccgatagcgacggccattcatcactatccgattcagactctagtgtggtccatcagggtaaatctgccaccgaaggggaatccttgccaaccaatacgccaccggagacaccccccgttgtagcttcaggcactatactgcctactgacggcagacggcagttcttacgattagcgcggctgggcgccgatgggaatttagcactgctgcagttagtcgaggccttgaaccaaaccgaaaaatactccaccaaccgcaacgaggcggagaaagacctggttggctcagagtacttaatcgatattagcgtcagctctatcgggcggacgttcagcttcagtctccccgaagattatcaggatggtcagaccctgaaaggaacactgcgcgacggaggcttgtccctggagttgtactgcgataaacttgtgggcagcgagcttgcggggcttagttttcctacacgcctgaaggtcctcataagagtcgtgcagtggaatagtatttttaagaggctcgaggcaatcgttctacacacaactctgtga

SEQ ID NO: 13999 - RNA, 987 nt, unidentified
  source 1..987: mol_type = other RNA; note = synthetic construct
atggttaggaggcccggcggtctggaactggcagagaaccagctggaagtgacagagcctgctaggggcgtacgtcatcttcagggtggtcgcggcacagggagatgctcttttctgtcaactagcacgcgattcgctgtcggtctattcgattggtttcgcaaacgcaaggatgaaggactcgatactggggaactggccagacgactaggcgtgtccgaaagcgatctcgactgtagtcctaggtacaacgtgcgaaccattcccaagaggaacggcggacggcgcaggatagctgaaccatctagagagttgaaacagctgcagagagttatactgcggcggctcctgagccgtcttaaggcacacccggcagcacacggctttgagaaagggagatccgccgtgacccatagcgccaaccactgtggcaagaaactgatcgtggtactggacatcgaagacttcttcagaaacaccaccgagcgccgagtgcgcgattactttaggtctatcggatggaatgagaaggcctcagagctactcacccgcctgaccacttttgaggggggacttccacaaggggccccaacatctcctcggctctcgaacttggttaattataccatggacctgaggttatccagattctgcgacatgcggagcattacatattccagatacgccgatgacttgtgcttctccactgatgacgaaagttggaccggccaactccttcgtactgtccctgagatcttgtcagacttcggctaccgcgtgaatcgggccaagacgcggttcttacgagcgcaccagcgacaactggtcacggggctggtcgtgaatgagaaagtcaatctccccaggtcaacacgccggtggcttagggctgtggaacatagaatgttattgggaggaactcccacaattagtgagcagcagtttcgggggtggctggcgtatcggcagatggttgagcgtagatga

SEQ ID NO: 14000 - RNA, 924 nt, unidentified
  source 1..924: mol_type = other RNA; note = synthetic construct
atgtcgatcctagactgggtgtcagggctgttaggcacagggagctcaggtacaggcgattccagaaggaatgaggggaatgacctgcgggaactcgctagacggttaggtgtttccgttgaggaactgacctcaattcgacctgcctatagagagatccgggtgaagaagcgatctggtggcactcggttgctcttggaaccatcccctgagcttaagaagattcagaggtgcatcttgcataaacttctgaagaggctcagtagtcacgaatccgtccacggctttgagagcggccgctctatagtgacgaacgctcagcagcacgcaaataaagatctggtcatctgcgtcgacctgaaggactttttccagaagacacaggtgaggcgcattcgcgagtatttcacattcataggctggaacaccgacgccgccgacatgctgatgcatttgactgcctggaatggaggactgccccaaggtgcgccaaccagcccaaggcttgccaacctggtgaaccatgctctggatgcaagactagagggactggccaagcatcatggaggaacgtacacccgctacgcagacgaccttacatttagcttccccacccggaaggaactccccaaaaaagagactggaacttttctggagatggtgagccggattgtcaaagagaacgggtatagtatgcacggcaaagaaaagctgcgcgtgatgacctacgcgcgttgtcagtccgtaactgggctcgtagtgaaccagaaggttgatctgccgaggaggaccagaaaatggcttagagctgtggaacaccaccgggtcaccggcaaacctgcaacactctctgatgaacagttaaatgggtggcgaagtctccgtcaaatgatcatcgatcaaagacgcgagcgatctcgttga

SEQ ID NO: 14001 - RNA, 981 nt, unidentified
  source 1..981: mol_type = other RNA; note = synthetic construct
atgggcttctgggactggctgcggcagttgctccaaggtcctggcccgcaggaacgtaagccagatctcacaccaccagtggacggaaaaaagctggaagaattggcgaagcggctggacttttcagtggatcagcttcatgcggtccaggtttcctatcggcaattctcgattcccaagagaagtgggaacggttttcggacaatttccgtgcccaaccccgagctgaaagaaatgcagaggaggatcctgagacgcctgctcgggaggctgcagactcaccctgcagcaatgggctttgagcccggccaaagcatcgctacgaatgcagcttaccacgtgggggctgacgtggtcgtcagaatggacataagagatttctttggagctaccgtgactaacagagtacgtgcgtacttctatggaattgactggggcaaggaagccaccgatgtcttagttcggctgtgtacctatgagcgcgggcttccccaaggtgccccaacatcacctaggctcagtaatctcgttaacttcgaactagatgcacgattggacggttacgcccagaagatcggagcccgctacaccaggtacgccgacgatatcacattttctttcaattttgccgagatcaagcagacgctaaccggccagaattccaaaatacttgagcacataaaggataagagcaaaagctcttacgtaatccatcagactatcaggatgaccaaacgcattctgttcgagtacggctatcagatccacacaaaacgcaagcttaacattagacgaaagcaccagtgccagaaagtgaccggactggttgtgaaccataaagtcgccctgccgagaaagactcgaaggcgtttgcgggccgtggagcatcacttagctaatgaccgccctgcaaccctgactcatgagcagctcgctgggtggaaagccttacagtatatgattgagacacaaactaagtga

SEQ ID NO: 14002 - RNA, 981 nt, unidentified
  source 1..981: mol_type = other RNA; note = synthetic construct
atgggcttttttgattttctgaagaggctgttctccagcgaaccggagcgaagagcaccccggttagtagcccctgaaccagggctaggccctgatgaactcgctaggcggctgggactgtccgtgcagcaactggagagtaccccttgtgactaccacgagttcgctattcgcaagcgctcaggaggtactaggcagattaccgccccaaatagacagctgaagactgtccagcgcaaaatcctcaagcgcctcctcggcagactctgttgccacccttgtgctacggggttcgaaaaacggcactcaatcgtgaccaatgctgccgtgcatgttggagcagacgccgttctgagaatggatatgatcgccttttttcgaatgacaactgcagagaggatccgtggctacttctatgggatcggatggggcaaggaggcgacagacctactcataaggctgtgcacacacaacggtgcgcttccccaaggcgccccaacttctccgcgtctgtccaacttggtcaacattgaaatggatacccggctggcatgctgggcgcgaaaaattggtgccgcatacacacgctatgcggatgacgttactttcagttttccagacttagatgcttctgctcctgggcccgccttcgaccaaaaccccaagaccctggaaagcattagacgggatgaaggcgacgccttgatcaccagcacaataagaatgaccaaaaaagtcctgggggagtatgggtacgagcttcacaataagcggaaactgaacatacgaaggcggcatcaacagcagcgagtgtgcggccttgtggtgaatgagaaggtagcattgccccgcaggacacgtaggtggttaagagctgtgcgccatcaccatgccacgggaagacgggccacccttactgcacagcagttggctggatgggacgccctggagcatatgatcgctctccaggccgaggaatga

SEQ ID NO: 14003 - RNA, 981 nt, unidentified
  source 1..981: mol_type = other RNA; note = synthetic construct
atgggcctgttcgatcgaataaagagtatgctgggcgggggagccaaagcctctgttaataccgacagatggaatttggatgaactcgcacgtaggctggacatcacccctgatgaacttcaaaacatcaagcccatctataacaagtttaccattccaaagcggtctggtggtaaaaggacaatcctcgctccagctcccgagcttaagcagctgcagcgccggatcctgagacggctgttagctcgcttgcgcacgcacccctgtgcaatgggattcgagaagggccgatcaatcgtgacgaacgcccgcccacatgttcaagccgatgtagtgatccggatggatatacgggacttttttgggaaaacttcggcacagagggtgaacgcgttttggcggtttattggatgggacaagccttgtgcagatatattgaccagactgtgcactcatgacggcgcgctacctcagggagcacccacatctccgagactttcaaacctcgtaaactatgggctggatgcccgactggaaaagtggggtcagcccatcggagctatatacacgcgatacgccgacgatatggtcttctccttctcaagagtgaccatttccaatatgccagcctttaagaattggtccagattctatgacagtccaactgaggccctagacgacttcctccgcaaagcagtcaccagcactattagggtgaccaaaaagattttgaaggattacggctacaaaattcaccatcacaagaaactgagcattaggagaaagcaccagtgccagaaagtgacaggcttagtcgttaatgaaaaaatcgctctgccgcgtcagacaaggcgctggcttagggccgtcgagcactatcatactgctgggaaacccagcactctcacacctcagcagctccaagggtggcgtgctctgcggaatatggtggagcaacagcctgccaccgacttcacatga

SEQ ID NO: 14004 - RNA, 5727 nt, unidentified
  source 1..5727: mol_type = other RNA; note = synthetic construct
atgggaatcctggacctcctgtttcaaattggggacagacccgggcacctagacattagcgaattggctagacgcctcgacatgtctgtgaaggccctgagggaaacaccgctcgagtataaacgttttcggatcgctaagaggtctggtgggaagcggactattaaagctcccaaccccaacctgaaagccgtccaacggcgcatcctgagacggctgctcgcaaagctgactgcgcatccagccgcgaccggatttgagaggggagaatcgattgcgacaaatgctgttaggcacacaggatgtgaagccgtgctgcggctagatatcattgacttcttccataacaccacggttcagaggattcggcgctgtttccaccgcatcggttggaataggaatgctgccaatcttctggtcagattgtgcacccttgacggcggtcttccccagggagcacctacttctccgagactgtccaatctggtgaactatccaatagacattagactgaacgcttgggccgagaagaataatgtcaactattctcggtacgcagatgacattacgtttagtttcgagcgcgagacagaagacgatataggcaccgctattcgactgacccgcactgtgactaaggaatatggttaccgaattcacagagacagaaaactgtccatccggcgtaaacatcaaagacagatggttacaggactggtcgtgaatcagggagtggctctgcctcggaagactcgtagatggttacgcgcggtggagcataggttagataccgggcagaccgcttccctatcaaaggagcagttggctggatggagggcgcttgaaagaatgatcgatctacaagctggccgccgcgctaaaacacatcgtgatagccccactgccagacccccgaagaagagagctcctgagacggatgacatggttagagcccagctgcaactggcccgtgaacagctgctggatcttaccatgagaaacagacttttgaacttccaacgcaccaggaggacgaccattcggataatcgatgagctgccaggtcaattatgggagttgtttgtggagaagcagaagaaactggcatttctggctgcggaggaacatgagctctttcaggccgctggagatgacctgccaccgaccgatgagccaggcgaagaggagccggacgaagatgcaatcccaggcgatctcgcaaagcttttccatcagccccgtcccgaaaccgcacttgaggacggccagaccgaactgccagcacgctacaccgacctgttccttcagacagacctcagagacgaggacttacagatcaacctcctgcgtatcgaccagcagagccactccgctctggaagagcggggcgtcaacctcctgtttctcgcaatgggattcctggaatggcgtccggatgatgatgagccaaaaacccggcgagctcctttagtgctcgtccctgcgggtctggagagggcatcagcacggagaaggtttaagctgagggctcttgatgatgatccaatattaaacccgtgcctcgtgcaaaagctgcgagagatgggcattggcctccccgcagagcctcagagctgggtagatttcgatacagagacatttttgcgggacgtgggcaaggcagtagctgagatgccggggtggcaggtgcacgaggacgtctacctgggcttcttctccttcacaaagtatctgatgtatctggacttggatcccgctaactggcctgaagggcggagactcttggagaatcgaatattgcgcaccgtttgtggtgatgctgaatccattgaacagatgggatcttggcccgatgtggcatctgaagaccgggagcgggacccagccgaaacttaccaggttttgaacgccgattcttcacagcagaaggctatattagcagcccgagaggggcgcagtatcgtcattgaaggcccgcccggcacaggtaagagccagacaatcactaacatcatcgcagaatgtctggccgccgaaaaaagggtcctcttcgtgtccgaaaaaatggccgctctggaggtggtgaaacggcgcctcgatgcaaccggacttggggacttttgcttagaattgcactccactaaggctaatagaaggaacttggctaccgagcttgggagagtccttgacaagggacgaagaacagctagggacgagatgggagacggcgagaggctccgcttgctcaagcggagaattagcgctgttgcggccgcagtgcatgaccgacacgaccctttaggtatgagtccctacgaggccgtcggaaggttttccttactagccgacgttcctgattgtttctgtgacattcctggctggcaggactgggatcgaggccagctagaagaaatgaaggggaggctcgatcgtctggggaggcaggaacaaaatgtgggccctagagaagatcacccttggagaggcgtacggcggacacacgtgagctctcaagaccggagggatgccgagaggcattgcactcgcttggccggcatgctagcggatctgccacgcttcttaaaagcggtagccgacgatatccagacgccagtcccaggctccctggacgatgcctcaaaggctctggaggctgccaggcttgttgcggacagtcctggacccccccgtcgtcttctgcttgggagcgaatgggagggcgatagaccagatcgaaaagcattcctcggcctggccactgagtttttcgagggccaggattggatggctacgaggtaccgcgaaggcgctctcaacggagtcaactgggagggcatgcacagacgctgcctgagatattgggccagtcctctgagatggtttcgtcctcaatactggagtgaccgaggcctactaaagggctttcgagagtcttcgtatcgaccagactttgccgcccaggccgcggatctgaaaaggctggccgatctagcaaagctcaagatggagattgactcacgtcgcgaagatgggatccggtattttgacgaggcttggcaggggtctgcctctgcttggggcaggttgagcgcaatggccgattggttaacgagattcagaacactccacagggatggttggctcggtgacaaggctgtgacaaccgccagttacgctggtgaccacgcagcaacagccaagaaagccagagccctcggggagaaactcgatgcgtttcactctggactggatgagctcaatgggctcttggacctgagcgcagatgagatgttcgatgtgcccgttttgcaggtagatttcgacgtgatagagtcgagatttaaacggatggctgcagccggtgaagaactggtggtgtggacccagtatcaggaggccctccagcagtgtgaagattccccactgaaaagcttcctcgagtcagccatggaggatgatagacccatggattcctctgtgaggcctctggcaatcgagaaacagttccttcgcctgtggatcgaggattgttttgagcgccgagaagagctgcgccagttcaactgcggggatcatgaggccgccattctggattttgccaagctggacgttgactggatccggcaatcacggcaacgcctgcatggcaggctgagttcacgaaggccagacgggagaatgcaggcggcaccctccagccaaatgggaatcgtgcagagtgaagtgcgccgcaaacgtggaggccggccaataaggaaacttctggccgatgcagcagacgtgatccccagacttaagccctgctttatgatgtcccccctgtcggtggcccagttccttgacccagccggtatagacttcgacgtcgtgatcttcgacgaagcaagtcaggttgagcccgccgatgccttaggcgctattgcccgcggacgccaactgattctggtcggggatccaaaccaactccctcctacctcctttttccacagcgggcctgctcctcggtcatcagcagacgctgaggacgccgtcggactagtggatatggaatctatcttggatcggtgtgccgttgtcttgagcaactgccggctgcgctggcattatagaagtcggcacgagagtctgatcgccttcagcaatcgcgaattttacgactcgcggctagttgtgtttccgagttgccacaccggcgatgctgaactcggtttgaaaactatttttcaccctcaggaccggtacgggcgaggtaaaggccagaccaatagggagcaggcagcacgcgtgacggattttgtgttcgaacacgccaggaggagaagggacgtgtctctgggagtgggggccttctctagacgacagcagcaagctattctagacgaaatcgaaaagcggagaatcgaagataactccctcgaggcctttttcgacagaaatcgccccgagccattcttcgtcaaaaatttagagacaatccagggtgatgagcgtgacgtgatcctgctgtccgttggctatggacgaagcaggccagccgagcgccttagcatgaattttggacctctgaatcaggctggaggctggagacgactgaacgtgctcattactcgcgctcgcaggcagtgtgtggtcttttcatccattttaggcgaggacttcgacttgtcagcgacacaagcccggggggtacatgctttgaaaggctaccttgacttcgcccgtgacgggatgttgcccccaaccgtagatgaagccgaagaggactcatctgccctggagagggccatctataatgccctggtagccgcggggcatactgtatgccggcgagtagggtgcggcgcagatgcaatagatcttgccatcgaagatccactccggcccggaaggtacctgcttggcatcgagtgcgacggcgccaagtatagagacaccgttactgcccgcgacagagatcgactcaggcagcaggtgcttgagggatacggatggcgtatacacagggtatggagcgcagcttggttcctcagtcccaggaaggaaatggaaaggctgaccgccgtaattgccgctgccagagctggtactctccaggcacgatttctacctatcgcgtccgcagcgactcaggagattgacgatgagatggaccttatccccgccgacgacagcagtcctattcccgttaaagcatatcgccgataccggccaagacgtaggcggtcctctgaacggttttacacggacagcctgacagaactcgccgcccttgtgaccgaggtggtcgaggtcgaaggtccagtgcatgaggaccaggtcagccggaggatgctggacatctacagattttcccgagggggctctcgcatagacgagaagatttcaagcgccgtccgggttgctgtctacggtgggaagattaatcggcgaggagacttcttgtggcccgcggacatggaaacacctcctctgcggcgacgcgacgatgacgatatcagagatatcgacctgatctgtcacgccgagatacgtcgcgccctgcggttgttactggaaacacaatttggcatgtctcgcaacgacctgactacccaagctgcgaggctgttcgggttccaggtgagcggatcccggataagggacaggatcgggcaggcaatccagggcctcttggaaagcggtaaagtggcagagtcaggggcaattctcaatgtgagctcccaatga

SEQ ID NO: 14005 - RNA, 960 nt, unidentified
  source 1..960: mol_type = other RNA; note = synthetic construct
atgggtttgttcgattggatcaagaggcttctgggtattgccccaaaaccaaaaaatatgttcgtggaggtggactttcggggcaggcctcagcgccaatctaccccagagaagcccctgggcgacttaatggaactaagcaggagactggccaaaccggtcactgacatgcaactgacgcccgtcagatatgacaagtttactattcccaagcgatccggcggacagcggcagattatggctccttgcccgaagctgaaggagatgcagtctcgaatccttcatagacttttggggggacttcgcgcccataggtccgcaatgggctttgaacgtgacagaagcatcgtgacaaacgctctgccccacgtgggtgctgccgtgatcgttagaatggatatacgggacttctttccttcgacagatgccgctagggtacacgcctatttccggggcatcggttgggataccgaagtggtggacctgctggtcaaactgacaaccctcgatggaggcttgccccaaggagcccctacctcaccccggttgagtaacttactcaactatctgatggacgcacgtctggacgggctcgccagatcacaagggggcgtgtacacacgctacgcggatgatatgactttcagttttcctacggataagggcaatcacaaaaccgctatagttagcgcgaccaaggatatcgttggggaatacggataccgactccacttgagacggaaactctccattcgtaggagccaccagcagcaactagtcactggactggtagtcaatgagaagccagcccttcctaggaagctgcgccgaaagctgcgcgcaattaggcatcggctggagacacaggggcaggcaactctcaccgaacagcagttagctgggtgggacgcactcacccagatgatcgagacacagcgcactccaaaaaacaaacagtga

SEQ ID NO: 14006 - RNA, 930 nt, unidentified
  source 1..930: mol_type = other RNA; note = synthetic construct
atggggctaggcgatttttttcggcgactgttctcagtctccaacgacgaaatgttcgcgcaggatttattgccatctcagggctccagggatgtgagcagcaagggtaaattaggagtgaacgagctcgctcgtcgcctcggcatcagcgtcgagcagttacaggccgtcccgatcgcttattccgagtttacgatacccaaacgctccgggggcaaacggaccattcttgcccccagggacgagctaaaaagtctgcaaaggaagatcctgcgaagactgttgggacggcttcggtgtcattctgcagccacaggcttccaacgtgggcagtctattgtaaccaatgctagaccacatatcggcgctgcagtgctgttgaagatggacatcaaggaattctttcccagtacaactgccgaccgtttgaaaaagtacttcaagtacattgggtgggataagcaggcctgtaaactgctgctggagtggaccacccataaaggtgcacttccccagggagcacctacgtcgcctaggctttcaaatctcgtgaatttcgctatggacgctcgcctcgcagggcttgctaagaaatttaacgctgcgtataccaggtacgccgacgacatgactttcagctttgctacagatgatcgccagtctatctatggcgccatagcctcaactaaaaagattgtgggtcaatgcggatacaagttgcaccagaagaggaagctgagactggccagaaagcaccagcggcagtgcgttaccgggctggttgtaaacgagaagctggcactgccacgccgcactagacggtggctcagagccgtggaacaccgactggcaacaggcggacaagccagtctcagccctgcccaactcgccggatggaaagcactgcaggcgatgattgaatcatcctga

SEQ ID NO: 14007 - RNA, 936 nt, unidentified
  source 1..936: mol_type = other RNA; note = synthetic construct
atggggctctgggacgcactacggtccctgctcggtttcaatgctcgtcgaccggctagacccgatcctgggctccctgcaactagggcgatggcagagccaggtagggacaccgggcagttagctcaacgcctcggcgtaccgctcggatacctggaaaccattcaaccccagtacaggacatttactatcccaaagtggtccggcgccccacgcactatactagcaccccaggacgacctgaaacagctgcagagaaccattctgcggcgcctgctgggaagactggcctcacatcgcgccgtgacaggctttgagagggggcacagcatagtgacgaacgctcgagtccacattggcgcggccgtggtcatccgcatggatctgaaggattttttccccaccactaaagccgccagggttggagagtatttcagattgataggttggaatgatgaagctgcagccttgttgatgcgcctttgtacccatgggggctctctgccacagggagctcctaccagcccccgtctctcaaatttggttaactatcgaatggacgcccgcttggctgcactcgccgctaaacttggcgccgcctatacaaggtatgccgatgacattaccttcagtttaggtcaggactgcagatggcttgctgccgctgcaatccggggcactaaggcgatcgtagcagactacggatacacgctgcaccagaagcggaagctgattatccggagaaggcaccaatcgcaacgggtgactgggcttgtcgtgaacgagcgggtggctcttcctcgttctacgcgaagaaggttacgagccatcagacactgcctagatacaggcagacctgccacactgacagccagtcagctggctggatgggatgcgctggagcatatgatcaggacccagtcccggagcgaatga

SEQ ID NO: 14008 - RNA, 1113 nt, unidentified
  source 1..1113: mol_type = other RNA; note = synthetic construct
atgggctttttcaaagacctgggcaagaaattggaggaagctcgccggctggccgaggagttgcaacagcaggcccaggaacaggcccagaagctgggtcagcaagccggcgtgcccattcctggtgctccagcacaaccccctgggacaggggctcctggtcaaccagcctggggaggacagcctgctcaagaagcaaggggtggagccgctcccgcaccaactatggcaccaggcgagagagaacctgcgcggaggagtcctccaccagccagatttgggccagatgagcttgctcgacgcctgggaacgaccgtcgatgccctaagggcagtacagccggactacacagctttcagcatccctaagcgttcaggagggcagagacggattctggctccggaccctgtgctgaaaagcctgcagcgacaggtgctccggcgagtgttgggacgtctgcgagcacatcccgccgcaatgggattcgagcgaggacggtcaatcgttacacacgctagagggcatagtggtcgcgcggtagtggtccatatggatattcaggactttttcccctctacaagggcagtaacggtgcgtgaatatttcaggcagcttggctgggacgacgcggcagttgacctgctggccaagctcaccgtgtgggaaggctctcttccgcaaggggccccaacttcccctaggctcgcgaacctggttaatcggaggctcgatgcccgcttagccggcaaagcagcccgcttaggcgctacctatacaaggtacgcggatgacataacattttcctttcccaccgccgatcccaaggcagtgatagacgccatcaggttgacccgggatactgtggcccgcgagggatatgctctccacctccgccggaagctccacgtcaggaaacagcatcagagacagctggtcaccggcctggtcgtgaacagaggggtgggcttaccccgtgagagacgcagatggttgcgggccgttgagcaccacctgtccactgggaagccagcaactcttacccaggcccaacttgctggctggtacgccctagctcacatgatcgaaacccagagaaatgctccccccagctga

SEQ ID NO: 14009 - RNA, 969 nt, unidentified
  source 1..969: mol_type = other RNA; note = synthetic construct
atgggcctgggagatatcctgcgacgcatctttctcggcaaggatgcatcccccgcgtctccgagagcacacgtgaacccctacgcccacagaccagacagcatttctgacgtacctgtgcgggatcagccatccagggacctgcatgagttgagtcagagattgggcatggacgccggggaacttgccgcatgccctatcgagtattctgtgtttcgtatcccaaaacgttccggtggtaccagagagatatcagccccttctgcgagtctgaaaaccttccagaggatcgttctgcgccggctgttagcccgactgaaggtgcaccctgctgctgaaggcttcgaaagaggacgtagcattgtgacaaatgcacggcggcacgtgggtcggtcagtcgttctccacatggacattcaagatttcttcggcagaaccactgagaggagagttagggactattttagaggcatcggatgggataagcaagcagccgcgctcctgacccgcctatgtacgcatgggggcgcattacctcagggggctccgacaagcccaagactaagtaacctggtcaattacgtcctcgacacgcgacttcacgctcttgctgctcggatgggggcagcctatactaggtatgccgacgatttgacattctcctttgaggctgaccgccccggagccgtaggatcagtcatccgggccgccaaggggattatagatgagtacgggtaccgccttcatactcgaaggaagctgcacgtgcgccgcgaacatgaccggcaggtggtgaccggcctggtcgtaaaccgtaaagtgcagctgcccaggccaacaaggagacgattgcgggccgttaggcaccatctcgccactgaccgcacagcgacccttactcccgctcagctcgccggatgggatgctctgcagtcgatgattaggacccaagctgatgccgcaagctga

SEQ ID NO: 14010 - RNA, 996 nt, unidentified
  source 1..996: mol_type = other RNA; note = synthetic construct
atgggtctttggcagataattcgcggcctgcttggaagcagtgaggccaacccatatagggcagctggcgcacctgatggtcctgtgggtcgagggtcagctgccgctgctccatctcctcctaaacgcagccgtcgcagaccccctaaattttttctagctgatctcgctctgcggctcggccgtgacagtaatgccctcagccagatcgccgtggaatatgaaaccttcagcatagcaaaacgttctggaggccggcgaacaatccatgcaccccagccggggctgaaggccttacaacgggatattctgcggaaggttctgggtggcctcaaggcccatccggccgttaatggatttaggcgggggcgctctattgtcacgaacgctctgccccatgtcggacactcggtcttagtaagactggacatccgagacttcttcccttccacgacagcgcgcagggtggaggagtattttaggttcatcggctacgacgattcttccgccgccctcctgacccggatctgtactcaccaaggggcccttccccaaggggcaccaacttcaccttgcctcagtaacctgctgaattatcgattggacgccaggttaagcgcactggccgcgaaaatgggcgccacctacacacggtacgccgatgacatggcattctccttctctgagccagcagatgctgctagagtgaacatgctggtcagtgccgctcagttggtgctatcaggatttggctaccgaactcatcaccgcaggaaaaggtccgttagacggagacacatggcgcagtgcgtgactgggatcgtggttaacgacaaggctaatctcccaagagcgacccgcagaagattgagggcagtcaggcaccatttgatgacaggaaaggaagcgagccttaccgccgcacaacttgccggatgggacgctctgcagcacatgattaaggtgcagtcagtaccaccctccgtgccccagtga

SEQ ID NO: 14011 - RNA, 918 nt, unidentified
  source 1..918: mol_type = other RNA; note = synthetic construct
atgggcttgggggaatggattgggagacttttcggcgggaagtctcaagaccgtgggggttccgtggctccagggagactggtcttggtggaactctcagcacggttgggcgtgagcgtcgccgagttacaggcagctcgagtcgagtatgctcaattcaccgttcccaaacgtagaggcggtcagcgaaagatcagtgctcctagcgatgggctcaaaaccctgcagagaaggattctgtaccggctccttggacggctgaagagccatcctaccgttcaaggctttgaaaggggaagatccatcgtaactaacgccgtgccacatgtgggtcgcgcagtcgtgctgcgtatggacattcgcgacttctttccaacgactacagcgaaacgggtggagatgtatttccggaggacggggtgggacgctgaatctgccgctctactgaccaggctctgcacacacgaaggcggactgccccaaggtgctcctacgtcaccgcgacttagtaatctggtgaaccaccccatggacgctcgcttagaggccttggccgcgacagccggagcaacatacacaaggtacgccgacgatctgaccttttcgctgcctcaggataccccgggcactaccgccagactaatcggatccactaaagcaatcctacgctcttatggctaccggttgcatcaggataagaaactgcggatatggcgacggcacgaccgccagatggttaccggacttgtagtgaatgagcgcgccaacctcccaagacgcctgaggaggaagctcagagccatagagcaccacctcctgactggaaggcctgccacacttactgcagatcagctgaatggctggaaggccctgcagaacatggtcgatgctcaggcgttaccccccgcacaggagtga

SEQ ID NO: 14012 - RNA, 969 nt, unidentified
  source 1..969: mol_type = other RNA; note = synthetic construct
atggggctgttcggctttattaagggcttgctgggaggcggtgcaggagatccgaggaaggaccccaccgcctctttcaagcgcgagcgacctccaaccagtgagcgagctgccccacccagacggagaggtagcagaaggccgagagatatcgccgctcttgccgcttggattggcgtcggcgaacgcgaacttaccagggtgtcgccctcctatcagactttttttatccccaagagaaacggcgacaggcgccgaatcgatgccccttcagctgagttgaaaaccctgcaacgccggataaatcgcaagctgttgcgcaggctgaaaacccacagggcggctacaggctttgagcgagggagatctattgccactaacgctgcggcccataccggtaacgccgtggtggtccagatggatatcagagatttctttccctccactactacacagagagttcttgattatttcagggccataggctgggaagacgatgctgctcgcctgttagtggatctcaccacacatgaaggggggttgcctcagggggccccaacatcacctcgtctgagcaatctagtcaatcaccagctggacgcacgtttagatcgccttgccgcacgctgtcacgcagcgtacacgcgatacgccgacgacatcaccttctccttcgcagacggggacccactcgtggttcggagagtaattcgggcgactaaaagtatcctcgcagagcacggataccggatacaccaccggcggaaactgcatattcggaggcgtcatgagcgccaggtggtgaccggtctggtagtcaacgacagggcaaatctccctcggcatacaaggagatggctccgagctgttgagcaccggctgatgacaactggaagcgccacactcacggagtctcagctagccggatggcgggcactgagacaaatgatcgaccgtgaaaggggatga

SEQ ID NO: 14013 - RNA, 951 nt, unidentified
  source 1..951: mol_type = other RNA; note = synthetic construct
atgttggcttggctgtttcaactgctccttagatccctcatcggcacctcaccacgcaggcactttcggttagctgagtcataccgggaaccctctccaaatcgatacaaaccaaagtgggtgaagcagagaaccctcgccgacctcgctaagcgtctgaacgtgagtatcgagacactgcagagtcataagccgacttatgcgcagctgtcaattcccaagaagtccggcggaacgagaatgttgcatgtacccgatgcagcaacaaaacggctgcagcgggctctactgaggcgtgtgatcggcccagccaaatcgcacgatgcagccatgggatacgagaggggtcgcagcatggttgaccacgctaaaaggcacgccgaccgggccgtcgttattggcattgatctccaaaacttctttcccagcacacgagcagcttgggtccgcgattatttcatagccgcgggctgggacaaggaggcagcgaaacttctgacccaccttactacacatgaaaatgctcttcctcaaggggcccctacttcccctaaactctctaacctggtgaaccatttaatggatgcccgactcaccgggctggcacgacacttcggagccagatatactagatatgccgatgacattatcttctctctgcctacggacgacagcttgctagttaagagtctagtcaatctggctatgcacgtcatcgcaaactgcgattacaggccccattggaagaaaaaattgtttatccgtaggagccatcagaggcagcagatagcagggctggtggtaaacaatggtcctccacggctgtcccgcgaaactaagagatggcttcgcgctgtgcgccacagactggccaatgggaagcaggccaccttaaccccgtctcagttggccggatgggacgccttcgagcacatggtggaaaatacatga

SEQ ID NO: 14014 - RNA, 960 nt, unidentified
  source 1..960: mol_type = other RNA; note = synthetic construct
atgggtttaattcagtggatagctggtttcctgtttggccgccctaatgagccgatctcccaagcccagatcgatgctgctttcccaaaacgccggagagtccgcaggctgagtttcgaagagttgagcagacggctcgatgtgaacgaagccaccctcaagggctttcgccccaggtacacaagattccaaatccccaaacgggcagggggctcgaggcgaattgatgcccccgatgcggccacgaagaagctccaacgtgcaatagacaagcgggtgtttggaggtgtgagactgcacgcggctgcaatggcctatgtgaggggcaggtcttatgtgcatcacgccgcccttcatgccgatcgtgctgtcgtagtatccatggacctggagaactttttcgggtccattagaagatggagagttgaggcacttgcgagatggttggggtgggacgaagaggcagccggacggatcgcagatttatgcactctagacggcaggcttccacagggtgcccccactagtccccgtctggcaaatatcctgagcataccgatggaccgcagactcgctggactagcccgaagccgaggggcagtgtactctaggtacgccgatgatctggtgttttcatttgatgctgacgagcaggacgtggttcacgaagtcgttcacattgcgaatctgatcatctgggagtcttggggcttcgagatggaagtccatcacaagaggaaactgcacattcgccgagccggatggaaccgccaggaagtctgtgggttggtggttaatgacggccctccaagacttccacgggaaacccgacgcgctctgagggctatgcggcatcggctggaaaacggaggagacgctgacgccacacctacacagctcgccggctgggagagcttggagcgtatgattcagcggcaggggtcctcaacccctaggtga

SEQ ID NO: 14015 - RNA, 1056 nt, unidentified
  source 1..1056: mol_type = other RNA; note = synthetic construct
atgggactgtttcggtggctcaagaagaagttagcccctcccgaccctttcgccgcctttgagtcacccgctgcacggtctaatgccgctggtggggttccaggaggagtggaagacgccgctggcgctgcaagaagatcaccgctgaggcgcagtagggctcctcaccgtgacggaagggatgctggaatcggcgccgctcgctttggcttggatgaactggccaggcgatgcgctggtcccggtatcgaccccttgacggtggaaccaggatatcggactttcactatcaccaaacgcaatggccgccctcggcgtattgacgcaccagacgagtccacagccagagtgcagagggcaattctcagaagggtgcttgggggcattccctctcatggtgccgcccatggtttcgagcgaggccgtagcgtggtgaccaatgcatctgtccacgtcgatagcgccgtcatagtgaaaatggatatccggaacttcttcggcgcaacaagggcggagcgagttctagggttttaccgtcggtttggctgggacgaggcttccgccgcaagactgactgaactaacgacacttcgcggcgggttacctcagggtgcaccaaccagcccacgcctcgcaaatttggttaactacagactggacgcgtcccttcatgcgttggctgactctgtgggagcccgatataccagatacgccgacgatatgacatttagcatggacgaggatgacgcttcgatcctgaactccataattggcattactcgcgatgcgctcattgatttcggatatgaaatacactggcggaaaaccctgcaccttaggcggactcaccagaggcagaccgtgaccggcatcgttgtaaacgatggggtcagtctggccagggatactcggcattggctgagagcggtagagcaccatctgagaacggggagagcagccaccctgacaccgacacaactcgctggctggcgcgcctacgaggcaatgatcgaccgaggggtcaacgatgatgggacaatcgccgacgaaggatga

SEQ ID NO: 14016 - RNA, 954 nt, unidentified
  source 1..954: mol_type = other RNA; note = synthetic construct
atgggtcttttttcctttttgcatggcctcttcggcggaggcagatatggatctgaagacctcgcccaacggctggggctcatggtgaagtggctggatgagacaaaaccccattatcagcgttttactattcctaagcgggcggggggtatcagagatattgatgcaccaaatgatgagctaaagaagttgcagcgcctgatccttcacagggtgctggcaggactgaaagcccatcctgcctgtaacggattcgagcgccatcggtctatagtgagtaacgcgcgtgtgcacgcacgcccggatgttgtcttaagaatggacatacgggacttttttggctcaaccggcgccgctcgggttaaacggtattgcagggctatcggctgggatagacgcgcctcgaacctgctcgtcaagctatgcacatggcaaggaggcctgcctcagggtgcgccaacaagcccacgcctcagtaacttagtcaattaccagatggacgctagactggctgggctggcccaatcaatcggcgccagatacaccaggtacgcagacgacattaccttctccttccgggcggacgaggccaatgaagccagatccagcctggcacgaaatccgaagaccctcgatcccgcagaatgtcgggacgatcacagactgcccactgctttcgctattaggatgaccaaggccatcttggccgactacggttataaaatccatcacaagaggaagctccacattaggcgaaaacaccagcgacaggacgtgacggggcttgtagtgaatcacaaagtgaacctgccaaggaggactcgtcgctggcttcgagccgttgagcaccatttagctacaggacgccccgccactttgtctgcagcccaattggctgggtggcacgcactgcagcatatggtagctacgcagagccagcccgggtcaccttga

SEQ ID NO: 14017 - RNA, 1170 nt, unidentified
  source 1..1170: mol_type = other RNA; note = synthetic construct
atgccctggggccccgatccagcctctctatttgtggatagtacaagagcaagacgccacgacgtacctgccgcactggcagctccctttgccggacgtcgaactgcacttaggaggccaggcccggtagccggtttggagactcagctgcccacttggcacgtagggcaaggtggtgcaggagccgggagaaaagcaagagccaggcctcgagcccccttcacagctgctgaccctatggggcttgccgacttactgcggggcctttttgggagaagcggtccagagccagaccggggtgctggaattgacgagctggcccgtcggctcggagtttcggtggaagcactgcaagctaccccagtcgcctaccggagtttcacgattccaaaacgatccggacgcggcgaaagacgcattgacgccccggaacccgccttgaaagcactacagaggcgaatattaagaaggctgctgggacggctcaaggctcatcctgcggctaccggcttcgaacgctgccacagcatagctacgaatgcgctttgtcatacagggcaggctgtcgtcctaaggatggacatccgcgacttctttccctctaccagagaggcccgggtgcaccgatatttccagaagattggctggaaccgtgacgcctcaggcctgctgaccaggctttgcacctatcgtggtggcttgccacagggagcgcccacttctcctcgcctgtcaaacctggtgaatgttctcctcgatacgcgcctcgaggccctggcaaagagcatcggcgcagcctacacacggtacgcggatgacctggttttcagctttgcgaaggatgaacgggtgtccatccatgctgccatccagaccacaaaaaccatcctggaagacgagggctatgccttacatcaggataggaagttgcagatcatgcggaggcatgagagacaacgcgttacagggctggtggtcaacgatggcgtgagactccctcgcgagacaaggagaaggctcagagctgtggagcaccacctccggactggtcgacctgccaccttgactgctgctcaactggcaggttgggaggccctgcgctccatgattgataggcaggtggatgctgcccgtggaggaggtggagcaggggaaggtcggggtgtctga

SEQ ID NO: 14018 - RNA, 921 nt, unidentified
  source 1..921: mol_type = other RNA; note = synthetic construct
atgggcatactgaactggctgttgggcagacgtctgagagcacgaaggcccgccgaatacggaccaccacgatttggcttagctgatctggtgcggcgcctcggcttaagtgaggccgagttgcgggctgtgcgcgcttcatatcgcgagttcgaagttcctaaacgaagcggcggtaccagaagactggccgctcctgaaccggcgctcaaagccctgcagaagcgtatcctgaggcgcgcattgggacggcttaaggcccacccagctgcgacagggtttgagagggggcactcgatcgtgacacatgcactgttccacgccggtaaggccgtggtcgtccggatcgacattcaggagttctttgcctccacagctgcttgcagagtcgaggactatttaaggcggattggctgggatgcagaagccacagccgccctcgtgaaactgtgtactcacaatggcggactaccccaaggggcccctacctctccgagactgtccaacttggtaaatcgcgggctagatgctagaatgcagaggctcgcagcaggattgagcgcttgctactcacgctacgctgatgacctgactttctcttttgaccgcgatcagagcagtgccgacgtgcgtcggctgattggaggtgcgaaagcaataattactgcctgtggatatcgcatgcatctcaagcggaagctgcatgttaggcggtgccaccagagacagcaggtgaccgggcttgttgtaaacggacagccctcccttccaagggaaactaggagacgactgcgtgcgatcgagcaccatcttcgaaccggccggcctgcatctcttacgcccgaacaactcgccggttgggacagcctcaggtccatgatcgagacgcagagggcacaaagtcccggtgggaccggctga

SEQ ID NO: 14019 - RNA, 975 nt, unidentified
  source 1..975: mol_type = other RNA; note = synthetic construct
atgtctggcggcccttgcgcaggtcacttcggaggtgctggggcacggcctagacctcagtcactccataagggaggatcaacggtaggcctctgggatcggatacgtaggcttcttgggggcggaacccctggccatgacttaccatcactggccgagcggctggaactcacagtagatgagttaagagccgtggaaccgaggtatcgaaccttcgacatccccaaacgctccggtggacaccggacaatcgatgcgcccgacgacaggctcaaggagctgcagaggcgagtgctgcaccgtgtgctgcatggtctgcgcgcccatccagcagttcatgggttcgaggacgggcgaagcattgttactaatgctaggctacacgtcgggaaggccgtggtgataaccctagacatcctggacttctttagtaacactaccagcagagatatttataggtatctgcggtttgtcgggtggagccgcagtggtgccagagagattgtccgcttgactacttatgagggggtgctcccacaaggagctccaacctcgccccggctgagcaacttggtgaactaccgcatggacgctaggcttgccgggatggccaatagttttggaggcgattacacgcgatacgctgatgatcttactttttctttgacatccgacgaacgggtggcagttcaaggacttatccgtacggcctgcgagattatcagagatgaggactacgaaccccatgcagataaactcaccgtgagaaggagacaccagcggcaggaagtcaccggattagttgtcaatgagcgcatccacctgccccgcgagacaagacgatggctgagagcggtagaacacaggctgcgcaccacaggctcttgttccctgacagaagctgagttggatggctggctcgccctgacttccatggtccacgagcagggtgaaggtgtgggcgtgccagactga

SEQ ID NO: 14020 - RNA, 903 nt, unidentified
  source 1..903: mol_type = other RNA; note = synthetic construct
atggctggtctgttcgcgtggatatcgaatcgactggaccccgggcgcagtgtggaagatttagccaggtggctgaaaattgaggtcgccgacctgcagagtgtggagcctaattacacaacctttagaattcccaagcggtcaggaggatttcgcaccatcgaagcccctgacgaaaggctcaaagaagtgcagagattgattttgagacgggtgctaggcggcctgaaagcgcacccttgcgctcttggattcgagagagggcggagcatagtgacccacgcccaagctcatgtcgggaaggccctggtcattcgtctcgatctcgtggactttttcccaaacacacaggccgaccgggtgctggaatactttcgctctatcggctggaaccggcgggctgctcaactcctggtgaagctgactactaacaatcgccatttgccgcagggcgcaccaacctcaccaaggctcacaaatctggtaaactataagatggatgccagacttctggcaatggcacgcaaggtagggggtacagacgccacatacactagatatgcagacgatcttaccttctctgttgcgcatgagggtgagcacactagcagggacatcatccggggagcttccacgatcgtgcgcgataccggctatctactgcatagaaagaagaaaacccacatcttgcggtcccatcagcgccagactgttgcaggactcgtggtcaacgataaagttgatctcccaagggagacacgtaggtggttacgagccgtcgaacacagggagaggctgggcagagaggcaactcttacgcccgcccaattatccgggtggcgtagcctgagacacatgattgacacccagcgcgatcctcccgctcgagttcgaaggcgatga

SEQ ID NO: 14021 - RNA, 930 nt, unidentified
  source 1..930: mol_type = other RNA; note = synthetic construct
atgggccttatggatttcattcggaggagatttggtggcgggagcggacgaagttctcttccagcccctgacgtaggaatggatgagaaacatctagccggccggctcggtgttttgccaggaaagctggagctgctgaatcccacatataaagtttttgagatacctaagcgcggcggcgggagaaggaagatcgaagctcccgccccgatgcttaaagaaatgcagaacctcatactgaggaagctgctgcggcgactgaaggcgcacccttgtgcctacgggtttgagcgggggcgttcaatcgcagggaatgctgctgtgcacgccggcaaagccgtggtggtcaggctggatctgaaggacttctttccctcgattagtgccgacagagtcagacgttattttcgcaggattggatggaacggcccggccgctgaactgctggtgaaagtctgcacccatgagggtcgcttaccacaaggggcacccacctctcctaggcttagcaacctcgtgaattactccctggacgctggcttgctcagtgcagcaaaaaagtaccgagcagactacacacggtatgccgacgacatcaccttctccttcgcaattgacgatcccgggcgcatccgcagcctgattggctcagccaaggcagtgctcagcggagagggctatagaatcaatctccacaagaaactgcgcgtcgccagatcccaccagagacaaaaggtgacgggtctagtggtaaactctggagttaaattgccaagggccactcgtagaaggctccgggcaatccggcaccgattagctgcggggaagcaggctacattgaccgccgcccagttagccggatggactgctttcgaagctatgatcgcggcgcatgatgatcccgctgctgcaggaggtcaggcctcctga

SEQ ID NO: 14022 - RNA, 954 nt, unidentified
  source 1..954: mol_type = other RNA; note = synthetic construct
atgggcgtgttcgacttgattagacgcttcttctcaaatcgggattacgatattcctcgagatgaccctagacaggttccccatgaccttagcttagaagtcagatatccacccgccctttctgttgccaccctggcggaaagactcgggatagccgagggacggctgcgtaatattgagccgaactataacaccttttcaattccgaagcggagcggtggaaccagacggatccacgctccctcccgtgaactcaaagccgcccagcgcaggatcttacggcgactgctagccaggctgaatgcccacccaactgtgtgcggctttgagagaggccagtcgaccgtcacccatgccctgctgcacgctcaacaggcggtcgtggtgaggctcgacatcaagaacttttttaccagtacggacgcctctcacgtagcaaaatactttcggcaaatcgggtggaaccgagaagcaatacgcctcattacagtgctgtgtactcatgacggagctctgccacagggcgctcctacaagcccacgcctgtccaatttgatcaactaccgaatggatgcaagacttgccgggctggctcaaaaccagggcgcatggtattcacgctacgctgacgacttgacattcagtttcgcagaggatagcggggagaggattcatactgtcataaggggggctcaccgcattgccgaacagcacggttacgagatccaccagagacgtaagcgccacatccggaggaggcatcagcagcaattggtgacgggacttgttgtgaatcagacagtaaggctccctcgccatatccggcgatggctacgggcagtcgagcatcacagaaggacaggcaaacccactaccctgtctgattcccagtggcagggttggcaagcgtatgctgcaatggtggagcgtcagtccggagccactccccagtga

SEQ ID NO: 14023 - RNA, 957 nt, unidentified
  source 1..957: mol_type = other RNA; note = synthetic construct
atgggactgttcaactggatttccaaactgtttaggcgcaccctgcctccttcagttttcaagtaccctgagccaaggtgggacaagaaagagcttttacgacgtctgaatctcaacgagataaacctgatctataccgtgagagggtttaacccgagagacacaaatctccttgccccccatctcatccccctgggctattggtggcacaaaattccaaaaaggtccggcaagccacgtatgctgtattctcctaacccccggctgaaactgctccagaagctcttgttaagaaaggtcttcgctaagctcgctgtgcacagcgcctgtaagggctttcgacggggacagagtaactgcactcatgcccgacttcacgtcggcaaagcagtcgtggtgagaatcgatatcaaggattttttccatagtacaagcggaaaccaggtgtacgactttttcagaaggataggttggaatcacgaggctgcatctctgatccaggccatatgcacccgcaagaaccggttgccccaaggcgcacccacatcaccaattctcagcaacttggttaattaccggatggacgcccgtcttgcgggactagccggtaagtcccaggctatttatagcaggtacgcagatgatctaattttctctttcgaacaggacaatcgccgctttattcggggggtgattcggcgggtggttagcatcctgttcgaatcgggctacacgatcaataggaccaaattgaatgttatgaggcagcacaatagacaggtagtcacagggttggtagtgaatagaaaagtccatctgccgagatctactcgcaggtggcttcgatccgtggaacaccatctgaacactgggaagtcagccacgctgacccgcgagcaattagcggggtggaaagcttaccagcagatgatccaaactcaaagtaccggtaactga

SEQ ID NO: 14024 - RNA, 972 nt, unidentified
  source 1..972: mol_type = other RNA; note = synthetic construct
atgggcttcctgagctggctcctgtggggatcggggaaaagcgtgggcgatcttgctgaatggctcggtgtagacgtcaggcagctaaaaaggctgaagccggaatatcgggaatttactatccccaagcgaagtggcggcgtaagacgtatcgccgctccaagtgacgagctgaagaggatgcagagacggattgggaggcggttactgagagggttgagggcacacgaggcagctcacggcttcgagcgaaatcgttctatcgtgaccaacgcccgcgtccactgtggtcaggacgtggtcgtgcgtatggacctggtggacttttttccttccacttctgcgagacgggttcatcgctactttcgccgcatcggatggaatcgccctgcagctcggctgcttacaagactgtgcacccatgagggcgggcttccacaaggcgctcctacatccccgcgactaagcaacttggttaactatcgtctggatgccagaatagctgggttggtcgctgcactcggaggcaggtacacacggtacgccgatgacttaaccatttccttcgccgctgaggatgccgaagacgattgggttatacgatctggaccagccctcccttttgtgttagagggccaccccgagaagattcggtacctgaggtcattcattaggagagtggccggacaggaaggttatcgggtacaccgccgaaaaaagacctcagttcggcgccgccatcacagacagatggtgacagggctcgtcgtgaatgaggtggtgaacttgcctagggaaacgcgacgccggctcagagcaatcgcccatcgcgcagagcagcagaaaaggccccttctcgacgcggattacagacccttcagctatggtaggagacaaccaactctgacccccgcccaactggaaggatgggaagccctgcaggcgatgatcgtcaggcagcgggtggagtga

SEQ ID NO: 14025 - RNA, 996 nt, unidentified
  source 1..996: mol_type = other RNA; note = synthetic construct
atgaccatgggcctgatagggtggctgctctggggtaggggccatggtgtcggggaactagcgaggcgtttggacatcgagaggcgggatatacggcgcttccagccccagtatcgagagtttaccatcagcaagcgctctggaggaaggagaaagattttcgcccccaacgacgaattaaaaaagttacagcgccgcattctgcgtagactactcgctcggttgagagcacaccctgcggcccatgggttcgaaaggaggcgctccatcgtgaccaacgcttcggcacaccaggaccaggatgtggtgatgcgatttgatctggtcgacttctttccaagtacctcagagcatagagtaaagaggtatttccggcgcatcggctggaacagacctgctgcaaagattttgacgcggctgtgcacttacaatggcggacttccccaaggcgccccaacatctccacggctgtccaacacaataaattacctgctcgactctcgcttggctggaatgatcaacgccattggtggggcttataccagatacgccgatgacatcaccatctcattcagtcaggaagctgaggaggactggggcattaggagcggacctgcacccccgtttaccctccggaagcatcctgagaaaatcagatacattagggcctttgtcaggagggcggtgagagaagccggataccaggttcaccgcgggaagaaaatgaatgtaaggcgacggcatcaccggcaagaggtgactggccttgttgtcaatgatcacgttaatctgccccggaaaactcgtcgctggcttcgagccgtggaacaccgagcacggctgctcagccaagatcgcgagcagagccgttacgtgatgagaaaacgaccaacacttacaccgctgcagctggctggctggagagcctatagagcaatggtgctcaatgggacaggtaagactgccaacgctacggccactagatcccacaaatga

SEQ ID NO: 14026 - RNA, 1179 nt, unidentified
  source 1..1179: mol_type = other RNA; note = synthetic construct
atgatcagacggccagggccagatgggttagcagagcgccgacgggttgggcatctctactttcggagacgcagggcgggaccacagatccaagtggcagacaccaagcaggattcacaaggagcggccaaggctaacggccggagaggtgctctgtgtttcgccaaggacctcttccccttttccacacagtattctcgacggtccgtgatgggttttctgtcctggcttctctggggccgcggatttggtctgggagagctggccaggtggctggatatggacgcccgggaacttcgccgattccagcccgagtataggaggtttaccattcccaaacgctctggcggcaccagaagaatattggccccggacgatgagcttaagaagctgcaacgtaggattctcaggaggctgttagcgaggttacgtgcccacccggctgcccatggtttcgagagaggaagaagcattgtcacaaatgccagagcccaccaggggcaggaagtggtggctagatttgatctagtcgatttttttccaagtactagcatccagcgtgtgaagacgtacttccgcagaatcggctggaaccgtcggtgcgcaaaaatcttgactaggttgtgtactcacgaggggggccttccacaaggggctcctaccagcccccggctaagtaacctagtgaactacaggattgacgcccgactggcaggcatggcggatgcattgggcggtgtgtatactcgatatgcagatgacatcacaatctcattccccaaagacgagccagaggaagaatgggtaatgcgggccggagagccacctcctttctcgctcgcacggtgccccaagaaaattgcattcatgcgcgccttcgtaaggcgggttgtcggcgaagaagggtaccgcgtgcatcgccgaaagaagcagtctgttcgtcggcggcaccatcgacagatggtcacaggtctggtggttaacgacggggtcaatctgcccagaaagactcgccgctggttaagagccgtggagcacagggccaaaatggccaaagagacacctttcgacttcgctaatccttccgctaaaaggcctaccctgaccccttcacagctggaaggctggagagcttttcaggctatgatagctaatcagagcacgggaggagaagagtga

SEQ ID NO: 14027 - RNA, 1020 nt, unidentified
  source 1..1020: mol_type = other RNA; note = synthetic construct
atgggaattcgggatcccgtagtgaaactcttcgattggattgtgaacggcaccggccatggcaccactgagcttgcccgtcgactcggtatcccagagcaggaactgaggacagtggacccagtgtatcacgcgttctctataccaaagaggtcagggggtacgagaaaaattctggctcctgaaccccgcctgaagcgctttcaaagactgctgctccgacgggtgtttgccaagctctccgttcatcccgccgctactggttttgagcccggaaggtccatcgttactaacgctcgaacgcatcagggccaggccgtggtactgagattcgacctaattgactttttttctagcacgtctaccaagaggcttagaaagtatttccggcagatcggctggaataggccggccagtaagttactgttgcggttatgcacccagcaaggagggctgcctcaaggagctccaacaagcccgcgcctgtcaaacctcctgaattacaggctggatgcaaggctggctggattgatcgttaaactgagagggagatacacaagatacgccgacgacatcacaatttccttcgcaacccgggatcttcacgcagctgggaagtccgacttcccagctcgcaattctgcaggcgggactcccaatcacccaacccagacccctactgggcaggatacaatccgctctatcacacgggccgtccaaaaagttatagagagcgagggctatcgcatgcatcaccgtaaaaaactgagtgtccggcggcagcaccaacagcaggtggtgactggtctagtggtcaaccagagagtgaacttgcctcgtagcacccggcgatggctcagagccgtcgaacaccgcacacaaatgtcacagcccttaagccttacttcgtatcagcctggaagttacagcaggagaaagagtcccaccctctcccctgcgcagttggaaggctggaggtcatttcgagcaatggtccagcgccaggccatagacgattga

SEQ ID NO: 14028 - RNA, 987 nt, unidentified
  source 1..987: mol_type = other RNA; note = synthetic construct
atgggcctgattggcagactcatcggctggctgacaaaagggcggggacacggggtggaagagttagcgcggcgcctggactcagaccttctggacttgagtcgatttcaacccgattaccgccctttcactattccaaaaagatctggtggccagcgaagaatcctggcccccgagaggcacctgaagagactgcagcgacgtattctgatacgcttgcttgcgcgccttagagcacatcccgcagccactggatttgaaagggggaaaagcattgtgaccaatgctagagcacaccagggcagggctgttgtgcttaggttcgatctcgtcgacttttttccttccaccaccgctgagcgacttcggaagtacctgaggcggatcggatggaatcgtcctgccactgagatcctcctgcgcctctgcacttatgaggggggtctaccgcagggagctcccacttctcccaggctctcgaatctggttaactatcgcctagacgcgcgtttggccggcatggcagccagattgggcggagtgtatacaagatacgccgatgatctgacgatctctcttccggacgaagagcaggagaaggattggaccattagatccggcccaccgccattgttcgggctcgagacaaaccgggataagatacggttcctccaggccttcgtcaggagagtagtcgaagaagagggttaccgattacacaggcgcaagaagctgtccgtgcgacgtcgccatcaccggcaagaagtgaccgggctggtggtcaacgacagggtaaacctccctcgcagcaccagacggtggttacgggctgttgcccatagggcacggctcgctcgccaagaaggaccaggtccatcaaggccacctagtgggggcctacccaaaaggcctacactgacacccgctcagctgcaaggatggcaggccctggaaagcatgatcgcccggcagagaacggagggctga

SEQ ID NO: 14029 - RNA, 984 nt, unidentified
  source 1..984: mol_type = other RNA; note = synthetic construct
atgggctggctagaccgatggtttccgggggaggggcacggaattgacgagctggcccgtcgtctgcatgttgaccctgagcaactgagacggactgccccacgctatcgcgaattttcaatcgcaaagaggaggggcggtcgacgcagaattttggctccgcagactgatctcaagaatcttcaacgcagaattctccgctgcattctggccagactcaaaagccatcccgccgcaatgggatttgaacgaggccggtctatcgtgaccaacgcattaccacaccagggccaggctgtcgtgctccgactggacgtgaagaacttcttcgcttcaactcgcgccggcagagttcggaggtactttagactgatcgggtggaatcggcccgcagcagcgttgctgaccagactgtgcacacacgaagggggattacctcagggcgctcctacctctccaagactgagcaacctcgttaactacccgttggatgccaggctgtcggctatgtgtgagcggttgggcgctgtgtataccaggtacgcggatgacataaccatctccctctccgatgagaaagaggacaggccccttagaaatccccccccccgtaggggtaacgtgagtcctcccccacttagtagcgagcctaatcggctgaggtatctgcggcacttcgtgagaagagtcttcgaccaagccggttacacattgcactggcgcaaaaaggcaagcatacggcggaggaaccaccgacagctggtctgtgggctggtagtaaatcatagggccaatttaccacgcgagactcgaagatggctgcgcgctgtggaacatcgcacgctccttgaaaaacaagccaagacggcgcctctatcctcactggataggggaaggcgtaagtctccaacactcacacagacacagctagatggttggcgggccctgcggcttatgatcacccagcagatggaagagggatga

SEQ ID NO: 14030 - RNA, 1098 nt, unidentified
  source 1..1098: mol_type = other RNA; note = synthetic construct
atgaaggatttgcagcggcggattctgcgccgcctgctgaaaaggttgaggtgccacgccgctgcgagaggctttcagcctggagagtcgatagttacccatgcgactcttcatgctggcagagcagtcgtccttcggctcgacttgagggacttctttcccagcacaggctccagtcgagtatatcagtacttccgcaggataggctggaataggcccgccgctcgccttctgaccaacctatgcacccaccaaggcgggttacctcagggcgctcctacttcaccgaggctgtctaatctcctaaactatcgactggacgccagactggcggcaatggcagctaggctcggagcgcactacagccgttacgccgatgacatcaccctgagctttggccaagacgatagagatcgtatacgatatatcattaggttcgttaaacgtgcagccgccgatgaagggtatcgggtgcatggcagaagaaagttgcgaattcgtcggaggcaccagcagcagcgagtgacaggcctcgttgtgaacgccggggtgagacttccgcgccaaacacgacggtggctcagagcagttgagcatcacctcaggaccgggcgcgttgccacgcttacaccagaacagttcgccgggtggcaggcatttcgccagatggtagaagggcggcccagaactgcgtctccagctccactgccacctcccttggtgcctgtcccagtcgagctggacggagcttgggtgctggtcgccttacaaaagaacggacatgctattcccgtgaatatgccagccgaagggatcggtcccgccgaatggacctttgcctccggagagctgcggatcgcacagggtgatcacgaggagcgggccgactgttccgtggatgccagcactgaacctcccagaatcacaatccggccagccggacaagaagcaggaaccgctcagggaattttcaggctggagggtgacaaattaactatctgtgtgagtgaggagggtcagccgctgccttcagctattccctctgtacctggtacgggctggacagtgtaccacctgagagcactcgctcgccgctga

SEQ ID NO: 14031 - RNA, 918 nt, unidentified
  source 1..918: mol_type = other RNA; note = synthetic construct
atggggatatttaacaaactgaaaagcctgttctcatcgaattcttccgagccccagcaccaaaccccaaccaccccagcccgttttaacttgctggatttggagcaccgactggacattagtcataggcaaattaagcttataccgctcgactatcatacattcacagttccaaaatccaatggtcacaagaggttaattaccgcccctaatcccgaactgaagaagcttcagcgcaccattgccaaaagactcctgactaagctcgccgtgcatcccaacgccgtagggtttaggaaaaaccatagcgtcgtgaccaacgctaaagcccacactaattcccctatgatcattaagcttgatatcaggaacttcttccagagtactcccgcgcagcgcgtcaatcactacttcagattcctaggctatgacgctgattctgcgcaattgttgacttctataacaacacatatcgatcatctgccccagggagcaccaacgtcccctatcctttcaaatctgctcaactacaaactggatacagccctgacgacgttggctcaaaatcataaggccatctatacccgctatgcagacgacatcacatttagtctggataccaaagactcagaggcagctagaaatctcgtcaacgccgcggcttacctcttacaccagtttggctacaaactcaacaaccggaagaagcgaatcataagaaaccaccggcaacagcgggtgactggactagtggttaatgaaaaggtgaacttaccgcgcgagactagacggctgatcagggctatccagcatgcacacgacaataataagcctactacacacagccctcagcagctgcagtctctgaaggcataccaccagatgattattacccagagcgagtttgaaacccactga

SEQ ID NO: 14032 - RNA, 906 nt, unidentified
  source 1..906: mol_type = other RNA; note = synthetic construct
atgggattattcgacaaaattaaaggcctctttggatctggcagttccggcggggtgagcggtttgacgatcgacgatctcgcccagcggcttgacatgccagtggagaggctggaaggggtagagatttcctatcatagtttcactgtgcccaagtccaatggccatcagagaaggatcaccgcccccgatgacaagctgaagcaagtgcagagagccatcctgaaaaggcttctcaacaaactggcagtgcacccaaatgctaccggcttccgcaaaggttatagcgtcgtgtccaatgcacggctccacgtcgggtcagaggtgatcgttaaactggacattcgtaacttctttgagtcaaccaagatcaaccgggtgaacaagtacttcaagtttataggatgggatagaaagactgccaacctcctgacagagcttactacctataaggggggactcccccaaggcgcacctactagttctgcgctatccaatctgttgaactacaaactagactcaagccttaccaccctggctaagaagaagggagcaaggtactctaggtacgctgacgacatgacattttcgttggatgggtctgacagcaaggtcattaactcaataatttggggtgccgaatctgctttgcacgatctgggttaccggctgaataatcgaaaaacaaaagtcatccgcaagcaccgacagcagagagtcacagggctcgttgtaaacgagaaagttgcgctgcctcgtaaaacgcggaagttaataagagctatcgaacactcccaacagaatggccgcccgagcacacatagcgccgatcagctgcgcagtctgaaagcctatcaggccatggtggagaagcagggcgaagatggcgaattagatgagggatga

SEQ ID NO: 14033 - RNA, 939 nt, unidentified
  source 1..939: mol_type = other RNA; note = synthetic construct
atgtggcctatcttcacaccgctgtggcgaactctttcaggaggccgaagtgcccccgaagccggaatcgctcccttaccatttgaaagcaactgggcagagcggttagctaggctgggcttgagccccgagaaccagcgtgccattgtagcgtctggagccctccacccacacttgcactactggcgcttccaaaagccaaagagggcaggaggacggagagccatagcagagccagatcggaggctgaaaagacttcagtacgcgatagtgtcctggtgttttagtgctgaaaggagccacccagccgctattgcctatcagaagggccgatccacagctgaccatatctgggcacacgccggggcagagattgttatcaccgctgatatcagggatttcttcccgtccacccgcgccgaacggattgaaacctggtggcgggagagaaccgactccgacactgcgaggctcctcactctgctaacgacggatagagacggcctaccacaaggggcaccaacctcccctgggctgtctaattttgtgaatactgagctggacgctcgtctgacacgacatgcagcgccctcaggtgcccgctatacaagatattgcgatgacctggccttttcgtggcctatctctagcggtcccccttctggttttgagcgcggcgtccgtgccgctttgcatgagttcggctacaccctccaccccgaaaaggggtggagggtcagccatcggagagatgagcccgaaatcgtgggggccgttctcacaagaagtggaggggtccgactgccggacagacttaggcgcgtgattcgggccttggcaaggtcagcttcacctggcgacgtgcctaaactggccggttatagaggctacgcagctcaggtgactaatcggcccggacgccgcaaccctaaaacctga

SEQ ID NO: 14034 - RNA, 930 nt, unidentified
  source 1..930: mol_type = other RNA; note = synthetic construct
atgtggcctattttcaccagcctgaggcggaccttaaccgggggaagaagtggaaggacaggggaccggccgccagtctctagtgaagccgattgggccgagcgatttgctagattggggctgccacctgaaaccttgaggaatatcatagccgccgattccctgcacccctattttaggtacagacggttccacaaacccaagcgagatgggggcaggagggaaatcgctgagcccagccctcgcctgaagagacttcagagagagatcatcacacaatatttcgcaaccgaacagccacacccagctgcagttgcgtatcaacgaggcaagtctactgccgatcatgtgtgggcacatgcgggcgctgaaatcgtgataaccgctgatattagagactttttccctagcactagggccgacagggtggagatgtggtggcgtgaacgcgtggactccgagacagcgcgcttactcaccctgcttaccaccgattgcggcgagctgccacagggagcacccactagtccgggcctctctaactttctcaacactgagatggatgccaagttgactaggcgggccactggagcttgtgctcggtacacacggtattgcgacgacctggccttctcgtggccgacaggttttggccctccttccgactttgagcgaggtgtcagagccacgctccacgaattcggttacgagcttcatcccaaaaaaggatggcacgtacatcgccgcggagacgagccagaggtaacaggggccgtgctaacacgctcaggaggggtaagactgcccgcacggattagacagatgatgcgcgcactagcgcggcgagctacttcagccgacacggaacggctgaagggctacaggggttacgccgcaatgattgctacgcgtccccgtcgtcgcggctga

SEQ ID NO: 14035 - RNA, 951 nt, unidentified
  source 1..951: mol_type = other RNA; note = synthetic construct
atgaataaccctctgtccaccctgtggtacaaattgaccaacaattgggttgctatatatagacagcggtacggctacagtgatgactatctcacgctgggacagatgttaggctggggcgctatcggggctcttaatgtgcctcaggtgccttacccaacactcctgcgggtacttcggcgcaatagcatatatccggacttccgatacagacattttaccaggcctaaggcggacggctcattgcgagagctggttgagccagatgagaagctcaaaaggattcagcgcaagatcctgaaaactctactgaagaatgcccttattcacccttcagcggtcggatttagacgcaaaaagtcgactgccgatcacgcatgggctcatgcaggtgccgcaaccatcatcacagccgacatcgaagatttctttccccaaacgaagacttaccgtgtcgaagcttggtggaaatcttatttcattgagcagcccgaagccgaatctgccgcacgtctcctgaccctgctcactacctacaaggggtctttaccccaaggggccccaacctccccggcattatccaacatcctgaactacgaaatggacgcggccttggagaggcgagtggtagcctcaggaggtcagtatacacggtattgcgatgacatggcctttagctggggtggaattggcgatgtccccgcggatttcgagacagcagtcaggagtattgtgcaggagtacgggtaccacctgcaccgctgggaagtttggaacgcccacgacgagccagaattgacaggaataatcctagctcgtcatggcggcgtggagcttcccgacgacgtgcaacagaccattaggaggcttgccagaagcactagcgctagtgatatggcaagactccaggggtatcgggcttatgagtccatggtgaagaaaagacgctga

SEQ ID NO: 14036 - RNA, 984 nt, unidentified
  source 1..984: mol_type = other RNA; note = synthetic construct
atgttaaatgacctcccaaacactctcaggcggctggtgggactaccgcctgcttacagatatacctcacccgcccggaatgaaggtgaatggtccatggtgactctttgctataggctcggtctgaaagtcgaagacgcccaccagatcatggactctgccgccttcccatctggctttcgataccgcgagttcaccattcccaaacgggatggaagtccccgtcagttattggagccaggccccaagctgaagcaagtacaaagacggattctcactatgctgcttcgcaaagcccagcctcaccatgcagcgtacggctttaggagaaagaagagcatcgccgaccatgcttgggcccacgcaaacagccggatcatcattactgccgatatccaggacttttttccaaacacaacaaggcagcacgtgaagcagtggtggcacgagcaaggattcagtactcctgaggtgagactgctgaccgcactgaccacactgcacggatccttgccacaaggagcacctacctccccccctctctcgaacctagttaatgcccagatggacacggcccttgagcgtcacatacaggccagtggtgggatttatacgagatacgctgatgatctctgtttcagctggccagaggggtatgctccccctgcagactttgagttcgctgttagatccgtccttcacgaatacgggtatgccttgcatcctgataagggatggcaggtgtgggatcgcgatgaagagccaaccataacaggtgtagtgataacaaagcatgggtctgtcgatatccccgactcaatgaaacggattatgcgcacactgcagcagcatggcaccgctgcggacgacactaggctgcagggctaccaagggtaccagaggatgatcacccgcgagccgcgaccggaaaaagcaagcgcgggcttgggcaaggctcccattaaatcacctcgactgcgttga

SEQ ID NO: 14037 - RNA, 915 nt, unidentified
  source 1..915: mol_type = other RNA; note = synthetic construct
atgtggcaccgcctgccttatgcgctaaggaagctgaggcagactctcatccccatcagatacgaaccgcccgattatgccctgtggaacctgcaggcccgcttaggcctaacacccgcagaggtgtcacgcctggctatgccgggaccttttcccccacggtttcgttaccggcacttcactgtgccgaaaaaagacggcgggcggagagaaatctgcgcaccaggcccacgcctgaaggaagtgcagcgacagattctccgcgcttacctggatccacgggctccacaccctgcagcaatgggcttccgccgtgctctctccatcgctgatcatgcctgggcccatgcgggagctgccattattatcacagccgatatagaggacttcttccctagcacccgggcacgaagagtggctgcttggtgggccgcacaggggtttaatgacgccgaggtccacctgcttacgcgacttaccacctaccgagggtctttaccacagggggcccccacatctcctgcccttagtaatttggtcaacgccgagttggacgccgcactccacaggagggcccaacagagcgggggtgtctatactagatattgtgacgacctggcctttagttggcctgatggtggcaggcctcccgctgatttcgaaccagccgtgagggccgcccttctaggagctggatacaggttgcattccggcgcggagaagggctggcaaatgtgggcacgaagagacgagcctgaagttaccggactggttctgacaaggcgtggaggtgtagctctgcccccacccttgtatgctaggatgagaagcctcgcgcggtcagacgatccccatgacgcagcacgcttggcgggctacaaagggtacgagctcatgataagaaagagacggtga

SEQ ID NO: 14038 - RNA, 951 nt, unidentified
  source 1..951: mol_type = other RNA; note = synthetic construct
atgctcaataagctcccagctcccttgcgcaacctttttggactgtatacaagctatatgcagcctgtcaagcatccaggcgagtatgctctgtacatgatggcctatcggctgggcctcaatagataccctgtgtacaggtttctggagccaggaccgctgcccccctattacaggtatcgccactttaccgtgcccaagcaagatggcacccgaagggaaattgtagagcctgggcctaacctgaaagcagcccagcgcagaatcctccagttgtacttgaataatcgcaaaccccatcctgccgccttaggctttagaagaaagaagtcgatcgcagaccatgcaagagcccacgccggtgccgctttgattatcacggcggacgtggaggacttcttccccaacacgtctaggcagcggatcaagtcattctggcgtcaacagggtttcagcaccctggaggttcgactgctgactgcgctcactagttaccgtggtgcactacctcagggagctcccaccagcccgcctttgagcaatttagtgaactatgaactggatgctgccctggaccgaagagtcaaaccatcagggggcacatacacacgctacgctgatgacatggtcttctcctggccagacctagcgtcccctccagcagactttgagcagacagtgcgggccctgctcagggaagtgggatacactctccacccacgcaaaggctggcacgtgtgggtacggcgtgatgaaccacttgttactggggtgatacttaagcgggatgggtccgttgatttacccgactctatgaggcgaattatgcgggagcttgctcgctctgacgaccccaacgatagagcacggctggcaggttatcagggctacgaagccatgataaccggagatgccaccccggtcagtaggaggaaagctcaagggagatga

SEQ ID NO: 14039 - RNA, 957 nt, unidentified
  source 1..957: mol_type = other RNA; note = synthetic construct
atgttgcgcgacatccttcctgctccaattgtggatctgcttactcaatccttaggcgtctctctgcggcgtcctcgcggtttttctccgccagccggagatacatggattatctatcacttcttccgatacactctcgccatgcgcgacgaagacgcccgagcttttctggctggggggaagccccctaagggctttacttacaggcatttcactgtgcccaaaaaggacgggtcagatcggcaactggtcgagcccggctatgcactgaaagcagtacagcgccgcatcctgaggttgctggaggctcgaggggttaccaatcccgcagctcttgcgttccgcaagggcaggtctatcgccgatcacgcttggacccatgccggagcagccatcatcataacagccgatattgaggactttttcctgtccaccagccacaggcgggtgagagaagtgtttcatagcatcggctacgtggacgatcgggctcactacctcacccgcctgacaacttaccggggaagtctccctcagggtgcaccaacctcacccatcctcagcaacctggtaaacgccgaaatggacaagcagatagcccggcggacaagcgaatcgggcggaagatatacacgatatgcggacgatatggcgtttagttggccagatagattccgacctccgggggatttcgaacagacgattagggggattctgagggagcacggttacagactacatcctcgtaaaggctggcgggtttggttaaggcgggatgagcccgaattgaccggcctaattctcaccagaagaggaggagtcgacattccagactccatgaaagtgataatgagagagttggagaaggggcagtcagaggaccaagcacagagactttccggttatgagggcttcagacacatggttcaggccacgaggcgtcgctacagggcctga

SEQ ID NO: 14040 - RNA, 945 nt, unidentified
  source 1..945: mol_type = other RNA; note = synthetic construct
atgacaaggttggaccagatcctccccgataccctggtcagagttctcagaatgatcgctacgggatatgagcatattccataccgagggcacgatgatccataccggagtatctattggatggttggctaccgagtcgggattgaccctcccaccatcagagccattatggaagggggggatctacctgcagtgtggaggtatcgccacttcaccgtgccgaagaaagatggatctccaaggcagctgatggaaccaggacgggatctcaaagcagcccaacgcgagttgttgaggaggctgaatagcctggatcctcaccctgccgcactgggctttcgagagggtctgtccatcgccgaccacgcttggacccatgcaggtgccaggaccataattacagcggatattgaagactttttcccctctacccaggccacgcgcatctacgatttttgggtaagacaaaggtgggtctacgacgagatcgcagcgcggttcctgactcgcctcactacatacagaggaggcttaccacagggcgcccctacatcacccgctcttagtaacctggtgaacgtgggcttagacaccaagcttgctgcccgggcaagaagcgctggtgctacatatactcggtacgccgacgacctagtgttctcatggcctgatgagggacggccgccagctgactttcagcacggcgtccatgccgcgctgcatgagttcggctatcgtctccagcccagaaagggttggagagtttggcaccgccgtgacgagcccgaagtgactggcctgatacttacgcggggagggtccgtagatatacccgacagcatgaaagcattgatgcaaactctggaacgtaccgccactacagaagaagactttcagcgccttgctgggtatgagggctacaggcagatggtggtgcgagagtga

SEQ ID NO: 14041 - RNA, 909 nt, unidentified
  source 1..909: mol_type = other RNA; note = synthetic construct
atggcatctgtgctcgctcgtctcatgggaattttttccgtgtctactacaaaaatgtgtagggaagacattttcgagactcctcaggtcttccgcttgagcctgctgatggacgtgccatctgcgactcttctacgatttcgtagcggctggccgggagggcgatactactatcggccacttcgctgcgaaaagagagatggctcgccccggcacatatatgcaccaagtcccccccttaaggccttgcagcgcgccttgctgtcttacctgaattccttaaccgtccatcctgccgccctgggcttcagacgaggttttagcattgccgataacgcgcgggctcaccaaggccaggctgttgttgtgaccgctgacatcgaggatttttttgactccacgccggctcagcgcgtccgtgatttcttcagagctgagggttgggacaccaccgccgtctcaatcctcacaagactctgcacattccactcagtgctgcctcagggcgctcccacgagtcctgtgctgtcaaacttggtgaatacacacctggacgccgacttaacccgggtgattctccagagcgggggaaggtactcccggtacggggatgacctgactttcagctggtccactagagcggtcccaagcgggttcgaggcaaccgcaagggcaatcctgctgtcatatggataccacctcaacgcccaaaagggctggcggatctggagggtatatgctggagatgttgcctatatcacaggcataagactgggtctagatggaaggttacatccctctagtgaaatccagcaaaacatgcgcgagctgaggcatcagagaaatgaccctgtagccgccgcacgcctacaagggtaccagggttttattaaaatgcttaggagttga

SEQ ID NO: 14042 - RNA, 942 nt, unidentified
  source 1..942: mol_type = other RNA; note = synthetic construct
atgagcccttggaggccattaggtcggttgattcccacggcgctccgctctatcctcccaaggtttgagcacgattccggtgccatgggcagactgtccactatactcgggttaagcgaggacgagctacgcgcctttcgactgggtccaaggtaccactatcgtcccttcacgattcccaagcctgacggccggaatcgaagactgttggctccttccgctgccttaaaacgcctgcagcgctccttgttggatgaatacctgggcagacttcccgtgcatccatgcgctacagcctttcatcctggggcatcaacagttagacacgctttgccccatgctcgaggaacccggatcgccactgtggacctgcgggacttctttgaaagcaccacagccgcccgggtcaggcgtttctttgtgtcaaaggggtggaggggggaatctctcggcgtccttatgcgcctgtgcacctatcgcggctgtctccctcagggagcgcctactagcccttgtctatccaaccttgtgaacgagagactggatgaccgcctgcgggtacttgcaagacgttcaggcggccggtatacccgctatggcgacgatctggccttctcttgggtcgaacggcccatgccagccggattccaacgcagtatcgaggccgctctggagaggagcgggtacagtattcagccaaggaagggttggctggttagggaggcacgaggacgtccccaagtgaccggcgttgtcctcgcaggagatgggaggctccacgtgccctggagatacaggctgagaacagcatggctgcggtggagaggattctggagtcgcgatccgcacgtacgagcgcagtggagagggaggcaggcataccgtagaatggtggaacggggcaaagctggtccgaggcgaagaccaggacggtcgtcttga

SEQ ID NO: 14043 - RNA, 942 nt, unidentified
  source 1..942: mol_type = other RNA; note = synthetic construct
atgaacccaggtcaccctctttcctacctggtgcccccaacccttagaaggctactcacccctgcagggccatccagcgcacatgcacaagcactggcccagctgctcggcgttgccgaagacgagctggatgctatcaggttgggcagaagataccactatagacccattcggggcgcaaagccagacggacgcgaaagacggatactagcccccagtccgcctctgaagcgcctgcaacgacggctgctcgacgagcatctgggacggcttcctatccacccttgtgctaccgcatttcatccgggggcgtctcccgttttcaatgctctgccccatgctcgcggggccacaatcgtcactctcgacctgcgggacttctttgaggccacaagggcctggagggtccacagatttttccgcgaacagggctggtctggggaacctctccgagtcctcatgagattgtgcactttccgagatggtttgccacagggcgctccgacttcgccttgtttatcaaacctggtgaacgttcgtcttgatgagaagttaagacgcctggcggctaggagccgaggcatttacacccgctatgccgatgacctaacctttagttgggtggacgggggaatgcctggcggctttcaacgcgccgtggagaatgtgttggagagagagggatatgagatccagccccgtaaagtctggcgtgtgagccgagctcgggacagaccacgggtgacaggcctcgtgattgctggcgatgggcgggtaagggtaccatggcggttccgggtccgcacagttctgttaaggtggaggtcttggctgacgggagatcccgtggcccgagcaagatggaggggatgccaggggtaccttcgcatggtggatcgttcaagggaaggtgcccggtccaggcccaggaaaggtggatga

SEQ ID NO: 14044 - RNA, 903 nt, unidentified
  source 1..903: mol_type = other RNA; note = synthetic construct
atgacaccaaggcaccctttggtgaggttactgccgccttgggggcgagatgtggacgaagcattgcagagggaggctgttgccgatctcctgggcgtggccgtggacgaactagacgccattcggatgggtcctcggtaccactaccgccccttagcggggacaaaacccgatggccgagagcgacgcattcttgcgcctagcccagcactgaagaagctccagaggcgcttcctagatgcgtatctggtcgaccaagaagtgcacccagctgctatggctttccgaccaggcggcagtacgcttgcccatgctttacctcatgcccggagccggcttatcgccgctgtcgatcttcgagacttctttgaatccaccagaggagggagggtcgccagatggctggcagcacaaggctgggaccgtgaggccacacgcatcttgatgcggctgtgcgtatttcgggatgccctgccacagggagctcccacttcacccggcctgtctaacctggtcaataggagactcgacgagcgtctggacggactcgctcgtcgaacaggtggggtttatacccggtacggcgacgacctcgccttttcatggcctgatgaacggctacccggcggctttactgcctctgtggaggacgtactggcaagatccgggtatgaggtgcagccacgcaagggttggagagtgggtgccgccagagacggattcgagatagtcggactggtgctcgcaggcgatgggagagttcgcgtacccagggcccttaggtggagagccgctctgttgaggtggagggccgcattggttggggatccggcaactaccagacgggcacgtggactggcgggatacctcaaaatggtggatcgcgctccccgcaccagatga

SEQ ID NO: 14045 - RNA, 906 nt, unidentified
  source 1..906: mol_type = other RNA; note = synthetic construct
atggacctgaatcccggagagctcttgactagactgcttccgaactgcctgctcggccaagctgctacaccaagcgcgcagcggcttgccgacttgctgggtatcgacgtgcgagaacttccagccgtgcgcctcggtcctcggtatcactaccggccttttaccattcgaaagcctgacgggcgcgaacgaaggctactggccccttcacccgccctgaaggtgctgcagagacgtctcctggatagatatctggccgccttaccactacacgccgctgcaaccgcattccatgcaggcgcaagcaacgtcctgaatgctcgccgacatgcacacggacgcctgatagccacagtggacgttcgagacttttttgaatctacacgcgctgcccgcgtgagggctttctttgttcgtcagggttggcacgatgcagagttacatacgctgatgagactgtgcgtctaccgcaatggcttaccacagggggcccccactagcccttgtctgtccaacctcgtaaacagacccctggatgagcggctggagaatctcgctaggaggatgcaagcgacctacactaggtacgctgatgaccttacattcagttgggacagggatcatttgcccgatggcttccgtcccgcagtggaggatgccttgcacgcagccggctatgaagtccagcccgccaaaggctggcggatccatgggattggagacaggccagtagtgaccggccttgttctcgcgggaaacggacgggtctacgtgccgtggagtctaagatggagactctggcggtggagatggcaggcttggtggtctggggatgcgtccgctcctcttcggttgcacgggctggaatcatatgtcaggtcctgtgccgcagtgccagaggcctga

SEQ ID NO: 14046 - RNA, 1197 nt, unidentified
  source 1..1197: mol_type = other RNA; note = synthetic construct
atggagcatctcctctctcggttcattccgcggagtctccgaaatctcctcccacgccaatcaagcccctctgttagtgcaatggaaatgcgtctggtgggactgcttggagtatggccctccgaattcagcacaatccgcctgggcaggaaataccactacaggccctttagcgttactaaacgagacggtcgcgagaggcgaatcttggcaccttctccacccctcaaaaagctgcagcggatgttgttgcacaggtatctggacacccttcccgtgcatccagccgcgatggcctttcggcgaggctgttcaatcgtggataacgcccagagacatgcagggcagaagctggtagctaccctggatttggttgactttttcgagtctacaactgccgaccgcgtgcgtggtttttttctgaagcaaggatggcatggagaggctcttagcatgctcatgagattgtgcgtgtataggaatggcttaccacagggggcacctacgtcccctgcgctttctaatctggtcaactatgagatggatgagcggattgccgatttagctcggcgggctgacgccgtgtatacccgttacggggatgatctaaccttcagctggaggacagaacacatccccgcctactttgtccccgccctggtttccatactcactgacgctggatatgctatacagcctagaaaaccatggagggtgaggcccatgtccgacgaaccaaaagtgacaggtctggtcctgggtcggaatggcagaattcgggcgccactgaacctacagtgggaggtcgtgaagttgagatggcacctcttctggcactcaggagatgcccacgcacgcgctagacttcaggggtaccaagcctttttacaagcacttgaagtcaagtacgataaccacaatcatatcaactggcctgacaatctgcctggcctgcgatgggagatcttcaagctgagatggaggctgctgttaagacctggcgactccgacgccagaagtcgcctcgctgggtaccagagtctgctgtactattaccaggctaaccgcaagaatagcgcctcaacctatcgctacatttcggaaggcaatgatgactacaacgattatgacgacgaggatgactatgatgatttcgaggattacgacaacgacgatctagacgaacttccgttctga

SEQ ID NO: 14047 - RNA, 903 nt, unidentified
  source 1..903: mol_type = other RNA; note = synthetic construct
atgcataatcctcttgcccattttgtgccacggtgcttgagggaacttctctccattccatcaacacaagctagtgagtgggaagctcagttggcatattggctccaagttccagtcggtgagctccctaacattcggatggggccgaggtaccactatcgacccttcagcatcactaaaagggatggaagagagcggagaattctggccccttccccggcgcttaaacagctacagcacagactgctgcacaactacctgtacacgttgcctgtccatcccgctgcaaccgcatttcaaagaggctgtagcatcatggacaatgccaggcgtcacgccggacagaccctgatcgccaccctggatctcgtcgattttttcgaatctacaactgcagatcgcgtgcgcaggtttttcgtgcgccagggatggagggggaaggaactcgcggtgctaatgcggctgtgcgtatatcgagacggtcttccccaaggcgccccaacatccccatgtctcagcaatctggttaactacgacctggacgagcagatggcctctctcgctcagcgggcggatgctatctacacaagatatggcgatgatctgaccttctcatggagaaacgaccgagtgccggcttatttcgagcccaagctgagaggcatcctgactgacgcaggatacgccattcagcctcgtaaagcctggcacatacagcacatcaatgctggcccccagataacggggttggtgctgggtcatgacggccgcatccagattccccggcggttatactgggaggcattcaagctgcgctggcgattatggtggcgtccagaccctcatactgccgcccgcttacaggggtatgaaagtttttttaacacccccgggcttaggtga

SEQ ID NO: 14048 - RNA, 906 nt, unidentified
  source 1..906: mol_type = other RNA; note = synthetic construct
atggtcaagtactcttggcaaaaaattctcagggatatccttcctcagaaaaacattatggctgctaatactgatgacacaaaccttgaaatgctgtcttcgatctttgctatccggattgacattttacaagaagtgagccggagcattcaccgtcattatacgacattcgagataagtaagaagaatggaggcacaagaaacatctatgccccgaatcctaccttaaagaaagttcagtatgagatcttccattacttgcagaacttcgcaatccaccccacagccacagccttcattcctggcggttccatcatcgtaaatgccagacagcacctgaatcaggaactcttcctaaccgtggacatcaaagatttctttactaacaccagtaccaagagggtgcggaatttttttcgcgatcagggctgggagaagcagagcctcgatatgctggtttccctctgcacttaccaaggtgggcttccccaaggagcccccagtagtcctcagttgtctaacgtgataaacatggaactggatgaggagatttaccaagcagcatccgcgtcctctgccacctatactagatacggcgacgacataacgtttagctggtcaacttcttgcatggatagcgggctaaaaaacaaagtcacccagatactgaccaatttcggctacgagatcagcccacagaaagggtggcagctgttttgtgcagagcagcagcccgagatcgtgggagtagttatgggctcagacggaaagctgagggtgccacagcgaattcacgagaagttggacaagctgcatcaaaagaacaatccagacctgcaggggcagatacgcggttatgaaaactacattaaaggggtggaatccgcttcagtctcaatcgcgtga

SEQ ID NO: 14049 - RNA, 960 nt, unidentified
  source 1..960: mol_type = other RNA; note = synthetic construct
atgggcctgtttgattttatcgggaagttccttgggacatctgccccggagacagcaagcaccaaagctgcaagcaatgccccagcctccccctacgccaaccagaattactatattaagaaggctgtgtacctaaagtattatttgggacagaacgagaaccaattgaaagagttccgacctgaatacaatacgtttcaaatccccaagcgttccgggggtgcacggactattaacgagccaaaacccgaaacaaaggcgctccagcacaagatcctcagaatgctcaggaatggcaatacgcataaatgcgcagtgggcttcagaaggggcagaggcatcgtgcacaacgccatacctcacgtaggcaaagccgtggttctcaaaatggacatccgtaacttctttccaagtgtcacgcgagaaaaatgcgttaccgccattatgcagactggctgggagaagggggctgctgaaatcctggctgatatttgttgcctgaacggaggactgccccaaggggcaccaactagccccttattgtcaaacatcgccaacacccgcctagactgtagactctacgggctggccaaaaagctgtctactggtacccagaaggtggattatacccgctacgcggatgacataactttctcctttgctacagacgaacctggtcttgtgaggggagtgattacactgattttccaaatactgcatgaggaaggctaccaggtcaataaaaagaagactagagtcatgcggcagcatcaaaggcagacagtcaccggtctggtcgtgaatgaaacaatcaatataccgcgcaaacagcggcgcaaaatcagggcggccatgcaccggatttcagtaggagaagagcctacccttaccaacgagcagcttcaggggtggatgggaatgttaagtctggttcagaagggcaaggaggagtatctgtga

SEQ ID NO: 14050 - RNA, 972 nt, unidentified
  source 1..972: mol_type = other RNA; note = synthetic construct
atgaattggctgtcccagcttactcgaggattgcggcgagaacggacaccggccgatttagctcgctggcttggcctgccggaagccgaacttagaccatggctggctagtggacctgcatgggccagaggctacgagtatcgacggtttaccattcccaaaaggaggggcggtgtacgggtgattgacgcgcccaccgagaagctcaaagacctgcagagacgtgttctcaggcgcttgttggccccgttagccccacacgctgcagcaactgggtttcgccgcgggcactcaatcgtggacaacgctcggccacatactgggcaggccgtggtgatcaacctagatctggcggattttttcccttcaatcgccgctgcacgggtcgacgcactcttcagggctgtgggctggaatgctgaggcagcccggatcctgaccgcgatatgtaccctcgatggcgcccttccacaaggtgcgcccactagccctgccctgtcgaacctcgtgtgcagacggctggatgccagactcgccgcattagcccgctcccaaggaggtgcttatacgcgctacgcagacgacctgacgttttcttttccagcgttcggccgcaatagacgcctgaggagacatgccggaagacctacacccggtaggaggcccgctccttcttgggtcaccccacgtagcctgctcggatgggtgagagcaattttggaggctgaggggttcagaatacagttcaagaagcaggttagagtacagcgcccccatcaaaggcagacagccaccgggctagttgtgaatcaggccgtcaacctgccccgagctacacgtaggctgatccgcgccatgcaacaccacgagaggctgggacggttagatgccgcaggacgtcggcgattacgagggcttgaagccctggcaggtatggtcgctaggcagcgggaagagcctcagcgaagatga

SEQ ID NO: 14051 - RNA, 960 nt, unidentified
  source 1..960: mol_type = other RNA; note = synthetic construct
atgtctctgttcaactggattaagcaggcattgggcagggcacgctctcctgcagacctagcccgatggctgcagcttccagaagccgaattgagactgtggctagaccaacggcccgcttggacacggggttacgaatacagaagtttcactctgcctaagaagaggggcgggacgcgagtaatagatgccccgacggagaagttaaaagctctgcagcaccgcatcctccgccgactgctcaacccacttaggcctcaccctgcagccaccggttttgtgccaggcttgtcaattgtcgataacgccagaccccacgctggacagggcgtagttatcaatctcgatttggagaactttttccccagcatcactcccgctcgtgtggaagcggtgtttcgcgcgcatgggtgggatgcagaggcagctcggatactgaccgcgatttgcacctatgagaatgcactgccccaaggagccccgacttccccagcactcagcaatctcgtgtgtcgcaaacttgacgcgcggctcgccgctttagccgagtatttcgacggcgcatatacaaggtacgccgatgacctgacactgtcgtttccctcctttggccggaacagaaggttacgtcggcacgctggacgtcctactcccggttggcgtcctaaaccagggcccgctgccccaagaaccttgctgacctgggttcgggccatcctcgaggccgaaggtttccggattcagctgaaaaagaaggtgcgcgtgcaaagacctcatcagcgccagaccgccacagggctggttgtcaatgaagtggtcaatcttccaagagctgtcaggagacgaatccgggctatgcagcacagggagcgactgggccaacttgacgaggccggaaggcagaggctaagagggtgggaagccctggctcatatggtggccaaccagcgcgagggatga

SEQ ID NO: 14052 - RNA, 972 nt, unidentified
  source 1..972: mol_type = other RNA; note = synthetic construct
atgaatttcctcaaggcgttcggccgcttagggggtcgcgaaagaggcttggcagagttagccaggtggctgggcctgccagaaacggagcttcgaccgtggctgtctagcgctcctgcttgggcccgaggatacgactacacacggtttaccatcccaaaacggaggggaggggcaaggactatcgatgctcccggggataagctgaaggcgttgcaacggagagtgcaccagcgtctgctggctggcctaaaactgaatcctgctgcaaccggctacgtccgcgggagatctattgtagacaacgcacggccccatacacagcaggctgtggtcattaatgtagatctagcagacttctttccctcaataactgccgaccgggttaaagcggtttggagggcacacggatggaatgacgaagccgcgaccgccttgacgcacatctgcaccctggacggtagattgccacaaggggccccgacttcccctgctctcagcaacctggtgtgtaggcggttggataaacggctctccgagctagcaagacgctgcgccggagcatataccaggtatgctgatgacctcaccctttccctccccagtctggggagaaatcgacggaggcgtcctggtcctccacgtagcggaccagcccaacctcgcttagcccaacgcgccagacatagtaggaagatcataacacagctgcgcgagattattgaggccgaaggctttagaatccagtggaaaaagcggctccgcctccagcgggctcatcaaaggcagacagccacaggcctggtcgtgaacgccgttgtgaaccttccccgggccactcgcaggcttatccgagctatgcagcaccgagatcgacttggtcagctcgacgaggccggcaggagaagactgcagggactggtgaacctgcagcagatggtgctgaagcagcgtaactcaactggcagatga

SEQ ID NO: 14053 - RNA, 1047 nt, unidentified
  source 1..1047: mol_type = other RNA; note = synthetic construct
atgcttcgccggcctggaacagctgcagctgccgaagtaggcctgcttgactacgtgcagcaggccgagctgcctgggttcctcatgcccgtcttcgcgagcctgaatcgcctgctgaaacgcgcgcgctcaccgaaggacctagcaaggtggctcgacgttccagagggggagctgagaggttggctgtccggtccagctccatgggctcgtggctatgactacgatcactttactatagccaaaaggcgggggggaacgcgcactattgatgccccaggcgacaagctgaaggtactgcaacggcgagtcctccaccgcctattgggacccttacccgcccgtcccgaagcaacaggctttgtgcgggggcggtcaattgtcgataatgctcgaccccacgtggggcagggcgttgttgtcaactttgacctcgccgattttttcccgtccatcaccgctaatcgcgttgaggctgcatggcgcgctttgggttgggacgcagaagccgccacaatccttaccaggatctgcactctcgatggaaggctaccccagggcgcacctaccagtcctgccttgtctaacctggtgtgtagaaggttagacgctaggctgggtgctctggcgcgatctcttcggggccagtatacgaggtacgcggacgatctgacattcagctttcctggcttggggcggaaccgtagaagacgacctggccctccgagaagcggtccagcaagacgacggccaaggggacccagtaggagagtgctggccaccgtgagagacatagtgatggccgagggattcgctattcagtggaagaaaagagtgcgaatccagcgggcacatcaacggcagactgccaccgggttggtgattaatcgcaaggtgaacctcccacgagccacccgcagactgatcagggccatgcaacatcgtagacgcctcgggagactcgatgatgcaggacgtcggaggttaaggggccttgaagcccttgccgccatggtcgatcggcagagagcggcacccggaaggtga

SEQ ID NO: 14054 - RNA, 954 nt, unidentified
  source 1..954: mol_type = other RNA; note = synthetic construct
atgaacctgtttaagagcttgtttaacactgtgtcaggggggcgtagtccggcagatttagctaaatggctggatcttcccgaggcagaactgcgggaatggctcaccaataagccagcctgggcacggggttatgagtacgcgcgcttttctattccgaagcgtaggggcggcgttagggctatcgaagcccctaataagaaactaaaagccctgcagcggcggatacttcgcagactgcttaaccctctgaagtttcatcctgcagccacaggattcgtccccggacgctcaattgtggacaacgcgcgtcctcatgccggtaggggggtagtgatcaacattgacctcgccgagttcttccctacaatcacagcagagagagtgacccaggtgttccgaagtttgggctggggcgccgaagcagctaccatcctcactaacatctgcgcctatgagggacgcttaccacagggagcccccacatccccggctctttctaatctgatatgtcgcaagctggacgagcgattcagcgcactcgtaaaacggtataagggccagtacacccggtacgctgatgatattactttctcctttcccgggctggggcgaaataagaggttaaggcccaaacccaagggacgaccaccactggcgcgacctgctcagggtggaccaggtaggactcttttgacactgatcaaaactatcgtggaagaggagggctttcgcatacagatgaagaaaaaggtgcgcgtccaaagaccccaccagagacaaacggctacgggcttggtcgttaatagacaggtcaatctcccaaggaccacccggcggctcattagagccatgcagcacagacaaaggctagatcagctggacgccgaaggccaaagacgcctcaaagggctggaggctctgatggacatggttagcaggcagagaggctga

SEQ ID NO: 14055 - RNA, 1011 nt, unidentified
  source 1..1011: mol_type = other RNA; note = synthetic construct
atggttcagaacgcagataggaaaaaagccgggagagcagtacggcgagagtatccagtcgtgggtgtttttaagtcaatagctcgtattctcgaccgtggccgcggacctgataaactagccgcctggctcggactacggcaggatgaggtcgaagcctgggcgcaaggtaggccaccagaaccctctggccgggagttctactacaataggttcactatccctaagcgggatgggaggacccgcgaaattgatgcccccagtgatgctctgaagtccatgcagcggcgggtgctccaccgcttacttaatccgctgccagccgcagcagaaagtacaggctttgttagaggcagaagcgtcgtgcacaacgcccaaccccacacggaccaggacgtcgtgatcaacattgaccttgagaacttctttccatccattaccgcccaacaggtgcgagcgagccttgtggcctgtgggtggtcaaacacatccgctgacatattaactaacatctgcacataccagggacgactgcctcagggatccccgacaagtccccctctgtctaatatggttgcccgcaggctcgacgcaaggcttgcaggtctggtgaaaggttatgatggccactataccagatacgctgacgatatgactttcagctttcccgctttcggggcagcgctcgactggaaagccagcaccgccgtaaagcaggccagatgcaagctgctgtcaatgatccagatgattatagaggaagaagggttcaagatccagaggaagaagagaattcgcatccagcgggctcatcaaagacagaccgccacgggactggtggtcaattctcgcgtgaatctgccccgagagtttagaaggcgaatccgtgccgctgagcatcgcgagaagttggggaaactgtcggctgaggacaaagctcggttgagaggctggcaatcctggagggctatggtgtctcatcagggcgcacaggcggcaagccctccttga

SEQ ID NO: 14056 - RNA, 2376 nt, unidentified
  source 1..2376: mol_type = other RNA; note = synthetic construct
gctgccaagctcgccgggctccccgaagatatagcccgggaggatgtgtccatcgcaggactagacggcctgagactgagctggggggagacgctgttcgcaccagacttagcagccataacacctctgactgaccaggcagggcgctttgcaggcagcgtgttgggttgcgaggctcctgcatggtgttttctccctgtgggtagaatggccacacggctgcggttcagtagcgagctcgagtccatgcctgaatcgatgagacgacaactcgccgacgcctatattgagactcacccgcaaaaggtcgcaccaggccagggaggaatgcactggctgacggctaagagttttgagtgccccgagtgggaggacttatgcgccctccagactagtaaaccaacccccgagctgctgcaagcaatggccaataccagacaacgccgagccgtgaaggaagccatgcggtatctgagactgttccgggatcgcaattacgagaactgtgttacgcgcttcatgggcacagaactctggcggaaggctggcggggttaggctacaccaggatctggctgaagatttggagaaatttctcggaatgcctggggccgtgctgagtgcacctgaaaggcagaggttcgcggctgcggcgattctggatgcggaggacagggaggagctggcaagaaatttttctcgccttatcggatcacgcgtacccgctgagttcgtgttggagcacgtgtgtgcaggcggcaggaaggacgccgtacagctcctactggacagtgccccggacgccatccgtaggagatatattatcgatttcatcgggactcacttgtgggaacgggccggaggagcttcgctacacgaggacttcgcacaggatctggcccaggctctggccagtccctccagacagctggctgagtctgaattatgtcggatggcactgaggatggctgacgaacgccatgacgccagcttggtagccgctgtgttgcccgctctgacccgtagcgataagacctgggcggccgcagagcaaggcgttgaaacacccctgttggtcgaggccgtcagggccattgacgagtccgacattctggaccgggtcctctcttttgcaaaacagccggatatcgagctcgctgcccacgacgccctgcttcagtttcttatgttcgacgaagaaatcctcgaggaacatctttggagggccgagcatcggtgctctgcaaaacgactaccagaatgcgagacgacactcgctcagcttaccgcaatcgccattcgagaacatgggaacttgcgccgcatggcccgacttctgtccgctcatgcagaaaagtgcggtcttaaggggcggcaagcggaagggttagttgcccaggccttacgatctgctgcaaggctggtgtcacggcatggacggcatagggctgctgccctggaacttctctcttgcattggcttagagtgcgctacagctttgaaatacgtgctggccaatctggataggaaggctggctctggccgcgagctggatcacgtctaccatctgtgggaactacccaagaagtccggcgggaaacgaaccatttgcgcccctccaatgccattaaagatcgttcagagagccattcttcaccgtcttctcgagccactgggagcacacaaagccgcttacggattcgtgcctgggagaagcatcggtcagaatgctgcactccacgtaggtagcgaagtggtggcgaacacagatattagcagctgttttccttccgtgaggtggcagttggttctgggggtcctccgtcgggacttggggaaaactctgctgtcaggaaccgtgtcactggttaccgacatctgtactggtcagggcggcctacctactggcgcaccaacctccccggctatactgaaccgtgtcctgctgaaaaccgacgagatacttacagcagccgcagctcgtcgaggttgtacttactctagatatgccgacgatctcacattctccggcggccgaggcgcggttgaaatgcttggtgtcgcccgctcaaccttagagcggatcggactgaagttggatcccaagaagacaaacatctttaggaggggcagacgccagacttgtaccggtctggtggtaaacgataaagtggcggtgccaagagccatacgcagaaggcttcgtgccgccgtgcacgctgtcgaacaaggacgcgaacccgcctggcatggacgggaagataccgtggctgccttgggcgggagactcaattttcttgcatcagtccagccagagaaagctgcgcccctcaaggagagactggcgagagcgctccacggagggaaagataggtga

SEQ ID NO: 14057 - RNA, 3327 nt, unidentified
  source 1..3327: mol_type = other RNA; note = synthetic construct
atgactgccaacggggaggcacggttcgccgaagtcatcaaggcttttccaaccctgagtgaggctgaggtgttgagattgagttacgccttctttaaatctgagcccgagaatcaggcaattctcctgagtatcgctaaacggggtgcactagctagcgtagcccaagacatcgaggcccagtatccccctagctctgaggctgccacctacttgcttaaaggggaaaccctggtgcttccgggcttttgcactgccctgccaacagaaatacagctgcggtacctgctcgcgaagtgggcccattctagcacgcccaatgtgctgcagttagtccagaagttatcctcttttaagggcctaaaaagcttgatgctccaagccgagctgcaggtgctggtcggttacctcaaggcacactcgatttgggtgacgaagtgtgagcctgaggccactctcttgctccccaaggatttgatctccgggtttatgcatggagatgtggctgacgagtttttcctgggcgggagcgcgctgcaacatctggaggacttagctaattgcggactgcggtctattctagtatcagtgaataacgcctgggaaaaactcgaattcgacaagttaaacgaactcttcgaaagggttccaaatgcacttatcgatcacccgttgcagccggatctgcaagctgccctgaagaagagaatgatctcaagtagcaaacatacactggccaaaaggttgaagaggaagaaaaaccagacttggaactttatggatcagcgggtcgctaccgcactctctcatctgctggggttcaaagttccccggtgggccatcggtgatcacgaggctttcagccagattctcgtagaccaaaatctgctccagtgtttcgatgatcgccagctgcagaagctgatcaacgagatcggtatgcccgtgatgacagcgtgcgctgcgcaatctgcaacacagaaactggtcaaaaactatcctgaagcctacgcccctctgcctttgtctactatttggcgtgctgtcaatagagaagatatgttcaaggtggttggctggccaaaaatcaccctcgagtccctgaccttagctttaaatgcaggaatcgcccagcagaagctagtatggctgtcaggatacatgaaggccgtggatgctagtcagaaggaggcaattcagacacttttactgaccaagcatcttaaactcgctgcacgagtgattgaatcaaccgacccttgttggctgcaggtgccaattaaggcttgcgtcgagaatggcctttggagcgtggtccttcaggccgacgccaagagggtcatggatgaggtcccacggcgtttcctggtcgataaagtcctggggaactgtagaaggaaggccttctctagagatcctttcgaccgcatttatgacgaccagctccttgaggcctaccgggctctgacatcgaacactgctttacgaaggcacttcgtaacctctctgctcgagagatcctggtgcacagaccacaaagggaccggctacctcatactgggcggacgacgcttttcatatgtggcgttggcaactgagctgctgaggtgtaccgcatttgtcggagatcgcgactatagaaaggaagtggtcgtgcaaggccttaaatccgccaagtcacaatcccaccggcagactctgctgaggctgatacaacaagacgttatcgagactgacatgcccgaggcctggattaaagccgtgctctcgtggcccaaagaggttctgaagacactcctccctaagatgactggaaagttgctggacgcatacgtggatcgagtgggtgtaagaggcctgaatgcatgctacgcgacaagtcccaaggccctttcatccagacactttttcgccctgcgcgttactcgccttaaaaagggcggcgtgtggccagaagaccgcctattgaagagggacgaccacggctacgacgaggtgatagaaactgcgagcaatttcctcggcataagggaagccagatgtctggacatgtgcctcgagcgcatggcagataaaggagaagccgtgctgcagtatttgtgtgaacatgccaaagacgttatgagtcatgagctcacccggtgggttgatgtggttcttgccagatacgcaattgccccagaagccagactgaaagctctaaccagcgatgtgacgaccgcagatgtgaaattctggcctcagcagggtccggatggcgacgaaggtgatgtctacgcgtatttgcgggtacaccacagtttgaaggctctgagcgaagtctggtcagcccgaggtgtggtgccagataacgtgaggacaattatggccagcaagtggcccaacgatgctgcatggtttgagttaatgctcgtgctagggccttcatatgtgtccctcatccgccaggtaatgggaatgatggattttaaggctccatttgggtctagattcgacgcccattataggcactccaccatccctaaaaagtccggaggcgtgagagacatctacgcgcccgaacgggccctaaaggcccttcagacccttataaacgttaagttactgcaacccctcggtgctcacgatgccgcctttgggtttgtgcccggcaggaacatcaccgggaacgcggagcgtcatgttgggcagagcatcgttacaacggccgacatccactcctgtttcccaagcgtgggccgaggtctagtcgtccacgcactgaaacgggatctcggagaacggttgtcatatggagcaatacttaaaatcgctgacatttgtctctcccagggagtcctgcctacaggtgctcctacatcccccgcattgctcaatcgtgtccttctgagaactgacgagctgttaacagacgcggcaaccagtaaggggtgtacctatacacggtacgccgacgacattacattcagcggcggcgagggggcagttaatctgctgggcgtggctaagggggtgctgaagccgattggactgatgttggaccccaaaaaaaccaatgtttttcggcgtggcaggcgccaatgctgcactggacttgtggtcaacgaccgcgtgtccgtgaaccgagaaaagtgccgcagactccgagccgctgttcatgctctggagatggggaggccacttttgtgggatggcaaaccagaaaccgtggcacagctgcgcgggaggcttgcttttctggcgtctgtaaaagctgaggagggagcacgactgatggcccgcctagaagctgccctgcgtcagaagacgacggtatgcgcacagtga

SEQ ID NO: 14058 - RNA, 3681 nt, unidentified
  source 1..3681: mol_type = other RNA; note = synthetic construct
atgaaaaatttccgccaggccaaagacgagtcttccttttctctagagattcgggacgccgtgaatagtctggattttgctattcccagggcactacccaggggcgatccatttgcgcctagcgtgcccgaggagtactggaagaagatccgctccgccgttgaacagttgtggcccgcacgggttcggcccttgtttaaaggaaaggatgaggcccgcgcttatcaggaggcctggatctcagctgcgtattctcctttctgggactgtctgcgaatctccgcgttgtggtgtgcgggccaacctggcaggcaagctctgctagaagcagtaagacaggcagatgcagtccctagacagtatccccctgccgcttccccccttctgaaagcggtggaaagggggccgcacaatccctacctggacgaggaatctgccctggataagtacagagaggtctttcctatagggagtttcaccccacctattgacacgtgtatgaagttaggacgcctcgtcgtagaaagcagacggaagcgaccagcctgcgtgtctgcatgggacgtctttcgctgcctccctccaacactgccacacctgtcatgtaggtggctcacaagaacgcttcttgggttcgccgatgcgtgtgccagactcgggatacgaattaagaaaatccctgctgcatgtgccgcctttttgggtcgagacgccagcattgccatcaggagtcccgcagtgcgtagtttttttctcctaccaccaaaaaaagacttttctattgatgtgcgggccccagctggtatgacactgctgggatatttgttttacgccttctccaaaacaggtgagtacgaggccgtgttcatcgtgtccgagagcctgcttcgggcattttctggcgagccaaagctgctgaggaggttcaaggagagccctgggtatcagctgttccttaaagccgccgttcaggaggagcccacacccaaagggaggcgcgattggctgggagaaagaagatccctggaaggcaatcccagggtgggcgctctgctccgacacctattcggcaaaattctgccgggctggaaccggagtggacaggcaagcttcctggtagaactggccaaaggagccagggctaactgctactttccgagggagtatcagcgtttcctgttactggtgagcagcgagcgtcagaagaggcggttggaggaaagtggccactggctgcagctgtttgacctggaagacggctgtagaaaaggagctgctaactggaaattcattctcctccaggagtcgtgggatactgtatggaacgccaaggatcggttgcaggaggagcttaccgcggagaaagacgccagcgcttacctgcgattcgtcgcgcgtcatcatccttccggcgacctctcactggacttctacaacaataaaaagatcaaggagcggtttatctatgacttccatggttcccccctttgggagaaggccgggggtgcttgtctggagccacaacaggcggaagcactgtgcttcgcctgggggtctgctagctttaggggtcgggccggaagtttagctccagcgctggaggaggtcgggccatattgcctggaggacctcctggctctgatgctaactcctgccgggttgaggcgctgtagaggtgctctcctgcgggttctccccagagcttccgcggatgcagttcgccatatcgccgacagatgcgaagagggtgatgtgctccgagccattgccctgcatggcccggaagaagctcgtgtgccagcagccctgcgagcttacgatcaactcgcacccggcaaagctgcagcattgggcaggaagctcttcctggcaggactgccagttcgcttagcgcccggatggctggacaggggatcatggagcgccgagaagctgttcttggccctctgcgagctctgcggcgatcctgatagggccgggctgagacaagcccttgaggcgtgtgctcccgaacccgctggatcaaggcggctgagcagaaaagcacgtctgatcgttgccagacttgcagcacgtgctgctcggcgctttgaaccaggtgaggctggagctgctccaggggctctgtcagctcgcgaagtcggactcgcagaatggctcctcagggaagccagatgctgtgcttggggggccgcctcttacaatggtccaggccagagcatcgcccctgcccttaacgagatcgggcccaattgccgcgaagatttgctcgcgcttatgttgactccagcaggcgtacgaaggggaggaggggcacttttgcgcgtattgcacaaggccccagcggaagcagtgctggaaattattgatcactgtaccgatgttgaggtgcttcaggctatcgccttgcacggccctaaggaggcccgtgttcctgcagccaggcaagcatttgaccgcctccgcccccagaaggcaatcgagcttgccaagaagtttttcttagccggactgccggttcggttagcctggggatgccgggacgtgaaatcttggacccgcgagaagctattcctggccctatgcgcttcttgcgacaagcgggacgctaacgagctgtgtgaggtcctggatgtatttgcacgatcgttccaggggcccgacgctgaagctgctgctagaggcaccctcgaagaagtggccagactggcagcaagggccggcagactcttagtaagcgccgaagcggggcttgtggccggattatggccaggcaagcaagcaaggatcgtgaaatggctgatttcggcaatggactggaaagccgctcctggttgccgcctccagaagtcttatcgccgtttccacatccctaagaagcatggcggcaagcggctgatttcagagcccattaagaagcttaaattcctacagagaggggtgctcgagaggcttatagccccgctgggagcacaccctgcagctatgggcttcgtggccggcaagagtatagccgacaacgcgtctgtccactcagggcaacccgtggttgcagtggccgacgtgcataactgcttcccgagtgtcgcctggccggtgctgtacagagttctcgagcgcgaccttggccctcggttaggagctccagcatgcgcactcatagccgatctttgcaccttggacggtggattacccatggggtccccggcatccccagccttactgaatagagtgctgtttaaagctgacgagatcctggcctccgaagcgaagcgcaaaggctgtcgttacaccagatatgccgacgatcttgctttttccggcggtgaaggtgccgtcggcttaatcgccagagccggcagtgtgttgtcagctgccggcctccgactggatcctaaaaaatcctcggtgtttcggagaggaaggcggcaggtggtcactggcctgacagtgaatgcgaaacccgacgtcagccgagattacaggcggcgcgtcagagcagcagctgatcggtggcgcaaggggctcgaaccttcatggctggggtgtcctgtcacccgagaacagctattggggcggatagccttcgtcaacatgactagcgccgaggaagctgtgaggttgcgaaagtggatgagagaaggagatcggctgcgcggtaaaaaggggaaggccgcttga

SEQ ID NO: 14059 - RNA, 3000 nt, unidentified
  source 1..3000: mol_type = other RNA; note = synthetic construct
atgacagcaccagacccccgccaaaggagggctgaagacctctgtgctctgctggagcagcagggagcagatctgttcgcagcgcctaggatggccggattggacccatacgctcacgactttggcgcctgctggctgtccgagttcagtgccggcttagccccactctggccagcctgtctgagcctgtttgggcggcagctgcccaaacaggccgtgttgcagcagtgctggtctgtggctatggagcgccccctgtggttagggatgctgtatcgggcagcctgcgcggcaggcttatctcctgctgcgtcacccctgctgtgggctgaagcaagccggctcaaggccattaccgctgctagatggagaactgacgctatggcagttgcactcatggcggctgacgctgctgccgtagtggttcccgatctcggcccccaaacggccctgaaaggaagcctaaggctgcgctaccggttggcacacctttgtgcaacaggcgccgccctccagggactgatagacgctgcagcccaccagtcaggagtcactgattatcagcgcagagtggaactggcacgagccgtgcacggtgctcagtctgggggtaggaggtggcggccacttcgagaggtcgagtacctgctgctgactccgaaaagccgacagttggtgatcggaacgcctgccttgtggccccttcttctcggcgccgctttgcaaagactggcggccctcccagatcatctagctggtcgaatcgccgaacgtgattccctcagccgatggttggcttctatgatgctggccctgagggaaagacgcttggaccaggcaggggccgacattgcaagactggatgattccgccctcctgaggcagcttgtgctggtgttaagaagagagcaggcagggttgaggcgacttgatgctgacttcggcttagccactttacatgggagtgacgggagggcatgggcccctatggaggcagtagcccttgcccggctatcctccctttgtggccgcgcaatgccagtctggtgggccatgtcggccggtaaggtagctcagcagctcgccgttggcgccctccaaagtagtgagttgcctctccacgacctggtgctgctgcgtcgtggctggtgcgaagccgacgagctcttactcatagcggccggcaaaggagggctactccttgccgacgcagttggatggaggagcgcccctcttaccgatctcgtgcgcgtcgcaaatgagcccgggaagtttggcaatttcggcaggcaaaaactggccgacagactactcgccttgccagacgctcggccgtggcttctgtgcatggctggtcctcaggcacccgttttacgcgccttggcagaccgcgccatatcagattgcgcacagacttttgcgcgatcctgggggcggtttgtgtcttcttctattggcacgcccgaatggcagggtgtgatcgacgcggtgcaggatcagcctgggacatacccgctggtgttcatgtatggactcgcactcctggctgatggcagaacccccgtggcaccccaaggattcggacaggcaatgctggcctccctgtgcgtcgccgttggagatggggctgcaccactatcctcatctgccggattaccgggaccacttcccgagcaagcggcccaagctgctgccctaagcctgtcgacccaacgcctgttgcggcacctgttgcctgccgtactgcgctggctcgagttagacccccaggccaccgatggtctggtagacgagggcccagagcctctgctgatggcactggctgcgcatcctgaaagtcctctgcccctgctggatcgattacgtttcagtagcagacctgtactgcagagagccgcctggaggcagcgcttgcatagggtgtcctctctggacgacctccgtgatctcacactgcatctcccaccacaggtgggccttctgccgtggagaacccggtggcttagcctggctgccgatgacgctttgcagcgggcggtgactctcctagcctgtgccagacggaatggttggtggctccgggctttacacaagcacctaggggagcctctgtggttggatgggctgcagggggctatcacactgctgaaaggcagcgcagcgagagaagccgccatgctcgaacttgtccgtgctgtgggagcagaacttgcccccccgctgatggcagtgtttgcggctgctagacgatctgctgcccctgggcataagctcgatgcatcctatactcgctcactgcggcccaagaagagtggcggccaacgcgttatcttggcgcctgggagggcactgaagcgggtacagagggccgtcctggatcatctgctgctgccactggggagtcacgcttgcgcatgtggctttgtccccggccgatccatttgtgacaacgctgctcctcacgtgggacagccagtggttgtgaacgcagacgtcagcaactgcttcccgagcgtgaagtggcccctagttctgggagcccttcggagggatctgggccactccttggcccctgtcgctgtgtctatgctcgtcgacatttgtaccgctgagggtggccttccagtaggtgccccaacctcacctacacttcttaaccgtgtgttatggagatcagatgaggttctcgctcaggctgccgagcaacggggactgaggtacacacgttacgccgacgatttgaccttttcgggcagcgacaccgccgtccagatgcttggggtggctagacgcaccctagcgcagatcgggctcgctctcgatcccaagaaaacaaacatcttcaggcgcggacggcgccaaatggtgacaggtctggtggtcaatcagcaggtgtcagtcccacgacatattcgcagaaggttgagagccgccgttcaccgggtcgaacaaggcggtgttgcgcagtgggacggcgctgaacaaagcgctgccgcctga

SEQ ID NO: 14060 - RNA, 2934 nt, unidentified
  source 1..2934: mol_type = other RNA; note = synthetic construct
atgctcgacgtgctcaagctcctgaatgcacagcaggatcgccttcgaacgaccctgacggaactcgaccccttagccccccagtttgccgagactgcttggcaggcgatagccgctctggctgaacctctgtggcagccgctgcggcagatggtggatacagagagggacgtgtacgtactgcaacaggcttgggctgtgtgctggaagagccggctgcatgttgcgctgctctaccgagcaggaatggcgaaccctgcgacgcgggaagaagctctgcgcctaaggggtataacactggagaggtggcaaaagccactatcccccaaggatgacgtgcggcagcatgatctcgtcgccttcctgatggctgctgacgaaaccgaagctggagtgcctcacctcggccgtaacgcgtattacaagggtagcatccgccttcggtacgccctggcccatgcctatcgctctggtgccgccttaccggcactcttgcacctcgccagcgtgcaggcatgcgttaccgcttaccagcgcaggatcgaattttcacgcgtcgttcagcagggcgctattgacggacggatgtggagaagactgggggcaactgagtacgctctgcttagcctgagcgcccaggagttactggtggacgccccagccacttggccacaagttctgctccgacctctgaacgacggaaacttcctccagctcgctgcccagttgacggaagagcgcaaacgcctcaacggcttgctgtcagacctcatgcatgctatcagaatgagacatctggggaaagccgatgctatcttagcccaagtccccgataccccactggcccacgcactgtcccagagattaaagcgagagccctggggtctagatgacgccatgacgcacccctctatgcgacccgcgttcggaccgtgggtccctatgagtaaagccagtctggcgcgcttaaggccctgggcaccacaagccttacccgcctggtggggactgagtgctaccgaggtcgcccaggctattgggtcaggcgagttagtgccccaagagccagccagcgctataacccggtatataactagacaggacctggctcccctccaaagaacctggaccagagacgagcagctaacaattatcaaggccggtgcaggaaacctactgccaatggcagccccagcatgggatgacgttccattgcacgagctggttcccactcttcaagccatgaggtttgggacacattctattctggcacggaggcttgctgcgttgcccgatgcttcagaatggatcgcattgatggccgacgctcctgacgccgatcatgcacggaagttacgagagctcgcccaggccgccattgacacctgttggcacggcaataggatttcctgttggtccgagtggatcgtgtcagcatggggctgcgcagggtgggacagagtgcaacagatcgccctggcgcacaccactccactaaaagcagcagtcgccatgttcgcgagttcacgcatgccactcctccctggggagttccaggcagtgttagctagatccctgcaccacgctgagttgttgcccccacgccctctgccttggattaggcggtggctttcttatgatcctcttgctgcaagagctcttacactgcatgccccgttgctgtggcttgaacggctcgcccgcaacgtggccactcctacacagactcttgacgcccttcttgcctgccagtatgagtcggtggtgcggatggcttggaggaataggctgaaacgagtgactaggacagaggaactggccgagctagccatgagacgaccaaagggagcgggacctgccggatctgtgtatagatggctccagctgcccggcgctgatagaaatgccacactggtactaatccaccggcatgatgtgcgcagactgcgtcttttgcacgaggagtggggctctaccactttcgatgccgcttgccagagcgcacagcagcagttgattagcagggcagacgctggtgaacctcaggctagacgggaagccgccatgctggagctgcagacccgtctcgggctggattttgcagaacatatgcatcaggtcctgatgctgttgacccgtgacgccccttccgggcacaaacttgatgcgtcctaccgttctttcgaaatccccaaaaggcactcaggcatgcgacgcatcagtgcgccccacgctagcgtgaaggctgctcagaggatagtactgaacgcacagccacacgtagggcagccagtcgtcgttaacgcagacatccgaaattgtttcccttcggtcagatggcagctggtacttggcacccttcgcagggagctcggcaggcaattgtccccgacagcaattagcctgttgacagacctgtgtacagcacagggggccttaccagtaggagccccgaccagtcctgctcttctgaatctggtgctgagacgcaccgatgaagtacttagccacgctgcgcaacgcgtcggtgcacagtacacaaggtacgcagacgatctcacatttagtggggatcacagagcagtgggactcctccggctggccaaaaggactctggggtgcatcggcctggagttggaccctaggaagactaatgtttttaggagaggcaggcgtcagatggtgaccggcctcgttgtcaatgatcgggtgtccgtccccagagcactccggaaacgtctgcgggcggtggtgcattccgccgaacaaggcattgcaccgcattggaacggacgcgcctgtgccgatgatctctctgacgttcgtggctggttggcctttatgggcctgttgcacgccccccaagctgcaagattgcgagcccggctaaatgccgctgccccactggatcaaggtgtgcgggacgcatattga

SEQ ID NO: 14061 - RNA, 1386 nt, unidentified
  source 1..1386: mol_type = other RNA; note = synthetic construct
cggcgttggttgagctacgacccactagccgctcgagctctgaccctgcacgctcctctgctgtggcttgaaagactagcgcgaaacgttgcaactcccactcagaccttggatgcactgctggcctgccagtacgagtccgtagtccgcatggcctggcgcaacaggttgaaacgcgtgacaaggactgaggagctggctgaattagcaatgagaagacccaagggagcaggacccgcaggttccgtctataggtggctgcaactgccaggggcggacagaaacgccactctggtactcatccacaggcatgacgtgcgcaggcttcgattgctccatgaggagtggggctcgacgacatttgatgccgcttgccagtctgcgcagcaacagctgatatctcgagctgacgctggagaacctcaagccaggcgagaagcggccatgctggagctccagacacggctcggccttgacttcgccgaacacatgcaccaagtcttaatgctgctgaccagagatgcaccaagcggtcacaagctcgacgcaagttatcggtccttcgaaatccctaagaggcacagcggcatgcgccgcataagtgcccctcatgcttcagttaaagccgctcagaggatcgtactcgataagcttctgcagccccttggggctcatctggcagcctgtgggtttgttccgggccgcaacattgctcacaacgcccaaccccatgtcgggcaacccgtggtggtgaatgccgatattcggaattgctttcccaacgtgcgttggcagctggtgttaggaacactgcggcgcgaattgggccgccagctaagtccaacagccatcagcctcttaactgacctgtgtactgcccagggggccttgcctgttggtgctccaacgtcacctgctcttctaaatctggttctgcggagaaccgacgaggtgctgtcccacgccgcacagagagtcggtgcccagtacaccagatacgccgatgaccttaccttctctggcgaccaccgcgcggtgggtttgcttaggctcgcgaaaagaacactggggtgtatcggcctggagttggacccgcgaaagaccaatgtatttcggcggggaagaaggcagatggtcaccggcctcgtggtgaacgatcgtgtgtctgtgccaagagcactgaggaaacggctccgggcagtcgttcacagcgcagagcaggggattgccccccattggaatggccgtgcctgcgctgatgatctttcagatgtgcgtggatggttggccttcatgggactgctccatgcccctcaggcggccttactcagggccagactgaatgctgcagcaccactcgatcagggcgtgcgggacgcttattga

SEQ ID NO: 14062 - RNA, 1497 nt, unidentified
  source 1..1497: mol_type = other RNA; note = synthetic construct
agcttcaggcaggtggtagcgcggagtctgcatcacattgagctgctgcccccccgacctatgctctatatcaagcgatggattgcccgcgatcctgcctccgcaactgcactcgcagatcatggccccgtacactgggtacagcggttggtcgcgaatacaacgaccccgctcgccgcccttgatgccttaatagcttccgaagggctccctgcccctctgagaaggttagcgtggagaaaccgcatcgccagaacgcgggacgcccaaactctcgcagaattatctgcccgcatgccagccaacacaggccattttgatcagctcaatcagtggatggtccagggaactcaggcctccacagcaatggcactcgtgctgaccgcacgcagagatgggcctaggctgctccaactccaccagaggttcggggatgaggtgtttatcaccgcctgtagggaagctgctcaactgctacgccagatggcccaggaccccactagcggtacgagacagtcaggccgacacgacgcagctgccctggaactgctgggtcaccttggcgctcaagcggcaccccacttgatgcccgccttggctttatgcaggagccagcagccggctggatgtaagctagacggcgcctacgcccaacatagaatacccaagaaaaatggcacactgcggcttatccatgcgccccacccagcactgcgaaaggctcaacggttgattctggaccagctcttagcccccctaggggcacatcctgcagtgtgcggatttgttgccgacagatccattgttcacaatgctctacctcacgtgggccaggccgtcgtggtgaatgcggacatcaagaattgtttcccctcagttcggtggccgcttgtccttggagctctgcggcgtgagctgggacactcactgagccccgctgctctgtccctgttggtggacttgtctaccgcaggaggtgctctgccagtaggtgcgcctacaagtccagctctgctgaacctggtgttgcggggcacagatgaaaccctccatagttctgcagagcgagcggggctcaggtacactcgttatgccgacgatctgacattctcaggcaacagtcaggctgtgggtctactgcgccttgccgaacgtactctggcccagatcgggctgacccttgaccctgccaaaaccaatgtgttccgccgtgggaggagacagatggttaccggattggtcgtgaacaaccaagtctctgttccaagggctgctcgcagaaggttacgggccgcagttcaccgcgtggagcttaaagagcagccacattggaacgggcagccacaatccatggcagctctgagaggcaggctcgcttttgtgtcgatggtctgcaaaccgcaagcccagccactggtggatcggctccagagagctcttgcccaggacgagcgacccgattctgagcctccaagcccacagggaagcttggcctga

SEQ ID NO: 14063 - RNA, 2466 nt, unidentified
  source 1..2466: mol_type = other RNA; note = synthetic construct
atggccctcaggcctgccagaggtaatctgcctctgcccaccctagaggtcctaaggccaattctcctgaagagttttggcccccaaggaggtagacgctccttcctgaattccattccaagagtctctgggctggcgacatgcttggaagagggctttctgcaaggcctgagcccactgagccgcaccgaattcgatgagctaccgagcgccgtgaggagatggttcttgggatgtcctgcgcttgtttcagttggcttggacgaggggtttcgccgagatgtggccagtcaccccgactcccccgaaatggtagccctggagcactgggagcagaaagttctgccgaaagccctccatgcgatgcggtctggaatcctgtccgaagcagacggcttcccagcaggcttttttcggaatccactggcactgcgtcaacaggagccaatcagacaggccctccggtcacggaagcacttgtttgggccttctgccgacttcctcgggcaggaactgcctcaggccgccatcaggcgatttgaccctcgcaccaggcgcctgttacagtttcatggtgccagggcagaccagcggcttttggggggaccaggggatgacctcgaatccctgttacaacttgtgcgcgacacaaccgtggggcagcttgcagacgcaattcaccaatgttcatctgagggccccctcttagatctggtgcgactccaccccactgagcccgctgtcagggaagcaatggaaagagtgcttgggatcccaggcctgagatgggggttgctgcggatgctgggcagacctgtgctgcaagcagccggggaggatgcgctcgtatccatcttacgagccaaccccgatgtggtgacctgctgtgatgtcgagctcgctaacaggccggaattcggtagggccctcgtgcgatgctttaggagccgcgatggggctgctcgtgtgttgcacaggctgcccggtcgcgctgtttcagccttactttcggagacacaccctgtagtcggactagggggtgaaattgctcaggcgggggcacggagcagaaatcgaccgactcggtgcgctatcctggctctgttggttcgccacgcaccccgtttgatcgagggcacgtacgggtgggtcattccagctggcatccatcaggacgtggcacgcagggcactgtatcacagaagacatggtggactcggcgccctgttccggtttactgaccggaaaggacgccctcattggcaagagactgtgaggaagaccggagctacacctgccttgcgcagggtcctcagaagagacaggcccgacctgataccggagttgcataggtgggatgcattgcgggcgctgaaaacgccaggcttcaggcggcgactggtggcattcctcgaaggagatttcgaagtggacctcggtctggctccagccgctctgagacacctcgtgccttgggtccggaaacggtggattcgacagcccacagttgccctggcatacgaaatcgctcttgccctttcgccccgcgacgctagataccttctggccttgtgtacacagcgtgcaggaattgggctcatgcccccagggggcactgcattcgatagtctgtatagaacagtgcatataccaaaaaggagcggcggtacaagagcgctgcaggtgccgaatccgagcctgaagcggcttcagcggaggttccttgcccacggcttcgacgcaatccctctgcatgatgccgcccatggattccgtaagggacggtcaatcctttccaacgctgggccccacgccggaaaaccctgtgtggtgaacgtagatattgagggcttttttcccggcaccacctatagaaatatcttacgagcttgctctgagctcgcggatggagctcttagcccagctgccaggcacgtggttgccgatctttgctcttaccagggagccctaccaaccggtgctcctacgagtcccgccattggtaatattgtcctacgggcggccgacgccgccataagtaaggctgttcatcgcttcggcgtagcctacacccggtacgcggacgacctcaccttcagcggtggtactggctgtgtgggcgcattgcgttttgtcgagaaagtgctaggagaattaggctatcgcctgaacgctaagaagacgaacatatttcgacgcggcaggagacagatggtcactggcctggtagtcaaccaggcaccacacctgccccggcgtactagaagactgatccgcgctgcagctcacagagccgctacaggaggggaaattcagtggaacgggcgacctatgtcccgccctgagctcgagggccgtatagccttcctcaagatggtgcatccagaggaggccagggaactgctgggacggttaggcggcgatggagctcctggaggagttcctggcgggaaggggtctgcctga

SEQ ID NO: 14064 - RNA, 3114 nt, unidentified
  source 1..3114: mol_type = other RNA; note = synthetic construct
atgggggtggaccctaaggtcgatagggccgcactggccctggctagctccaagatgcaagtcgacgtttcagccgccactcttaagctggaggatgaagcagtgtccgatgtagatgagatccacgcccggctagccgaaatccttatctccaacggaaccaacggccggcggcttagggaagaggctagagacttagcacgtgaccgacagcgctgttggcgtggtcgggctaagtcccgaggcataagcgtagatggatatgcccgcaacctcatcgccagtgcgccaagacattgcctttgcgaactgattttcgtgtacctggatgccgaaaaagcttcagaggaagggttttcaaaggaggtggccgaatatctgaagaggagtaggaccaggagatctaacctattccgacaacttctggagacaaacagggtaccgacttctggagcgctcctgcgggtgctcgagtttagcgcaggtaaaattacccctgtgttagccggggaggcttttgaaggaaagtgccccgagaaagaaatagccccacgtctctctgccctttatcagtacgctagatctccggaagaggcagatgctttttgtatgaaatttggccatgccgtctttgatcgagagaagttcgactctctgtctcggaagctgaaaagtcgcatactgagtcagaagaaactgtccaggcgtctcctgacctccgacttccgacgggaaattgaaaacgatcctctgtcccatccagatacacccgagagcttgcacctcgctgcaacgcctaaacggaaccgggaggcatttcgacggatcgcgagcggctcttggcaacacgaagaagttgaggaactgatcctgagcggagctgtccatcagttcgcgagcaggatcgacaaactgttagcccgcaaggcctcttgggtggagcactcacggtcatctgggaggtattcctgggacgccgagagcggctggaagacaaatcctttcgagttggtgagcagtcccactagtaagaccgtacgcgaagcgattgaagcaattcggcctcttgccctgcatgacgatttgttcatcctgcagctggagactttggatgaacgcgccaagtttcttggcgatttgccatccggacggaggcgacgcatttgtcaacgtctaggtgagaaaccctatcttgagatactggaaaaagccgtgggtctagatagaggactcgctgagaaattgctgcggtgccgtgagaaatctcgtgagacactgagagagcagtttatacctagaagaagctccgagacagctatgattgatctttggttggagtgctttgactcccaggaaattttccgcgagttttttaagctgaagcgcctccaaggccggtggaggaccgtcttagaatactttgtgcgcgcaccgtacacccacctggggacatggcgccagaaggaaaagaggggcaccaaagggccccttccgtcacgcttcctgaatgcagtcctggagagcggtggagactggagaactttccagacagtaatgactcggctcaaagccgaagacttggctagactggtcgagcacgcacctgaccggatgcttacatggttaaccggcatctcggagggcttatcgtccgggaatagaaaccaggagttcgcctgtttcttggatgctatggtgcccgccattccaaagcgcttaggagacgtgctaccaagggagatgagcgacactatgttccgaaccaccctggagaagttggccggcccaatcagaaggggcgtgctcacaccaagcggctatagatggctcctgaatcgcaatacgagaggtggagatcccgcatggctggagctactggaggccagcagagagcgcaatcttagtccctccgaggaccccgcacttcatgttctggctagcggcatcctggcattaggggggcgcgacaggttccgggttctgttcgaagcctatcccactctgtacttcggtgaagccctggagaggctcgacttgtggactgtagtgcgacagaccttcgaccacccatccctcgccagatggctggagaggaaaactgaaagatctaaactcgttgtgctgatacccaaagtacgccgggaatatagatcaagaccaacagtcgctgccgctctggaggtggcgcttcgattttcactcagcgatgctaggtacctaaagtggctggccctgaaacgttggcaggctagaccgtgcgctgagggaaccgcgtttgacgacctctatagaacgcatcgtctccctaaacgggcagggggaagtcgggttatcacagcacctgagccccgactcaagaggctgcagcgaagactgttaagaaacgggttcgacgagctcccccagcactcagcctctcacggattccgccaaggccgctcgatcgtgtcgaacgcggttgcccacacgggaagggagatggtggtcagggctgacattactagtttttttccttctactgggtacgcccacgtgctcagatcatgcaggttgttagcggacggccaattgagtgaaggggcagtgagactcgtcgccgaggtttgttgttacgctggtgcactaccaacgggcgctcctacaagccctgtcatcggcaatctggtgctgaagcctgtcgacgcttccttggaggcggccagtaaaaagctcggtattatctacacacgctacgctgacgacctggcattctctggggatgatggcacccagaagattctcccatttgtccgaaaagtgctgtccgattacgggtaccagtccgatccaaagaaagaacacattttccgccgaggacggaggcaagtggttaccggcttggttgtgaatgagaaggcacacgtgccaagacggatccgcaggcggcttagggctgcagtgcatcacgccagccacggaaagaatccccattggcatggccacaagatgaacgaaaccgagctcctagggagactcgccttcctgcagcaggcacatcccgaggaagcctcagaactgcgtacccagttgcagcagagggaacatcagcgggataggaagggtcaggaagaatga

SEQ ID NO: 14065 - RNA, 918 nt, unidentified
  source 1..918: mol_type = other RNA; note = synthetic construct
atgagtgatttgcgggagatggaccacttgcgcgctattgcatgggccggtaggggagcaactaacttacaggctggctgtctgctggatagccgctacaggacctatgaactgccaaagagatcgggcggcgtcaggattataaccgcccctgacccaagactgaagcgtttgcagaggcggctcttagtcggcgcctttgaggctgttcctctccacgatgcggtccatgggtttcgctccgggcgatctattgccacaaacgccgctcggcacgtgggtcaacgactggtggtaaatgtggatatcgcaggcttcttccccaacaccaagttccaacaggtcttaagcgcgtgcaaaagagtggatggaggccgcctctctccttatgctgcccgtctgctggctgagatctgttgctacgcaggtgcgctccctactggggcaccaacctcacccgccgttgcgaacatcgtgctcagacccgcggacaccgccatagctaatgctgcagccacgcacgggatttcctacacaaggtacgccgatgacctgactttcagtggcgagggggacgctaagagaatcatcccgtttgtccgccgggtgctagctcaggccggatatcgcttggatcagcgtaaaacacagctatatagacgggggcggcagcagctggtgacaaatcttgttgtgaatgaacgggtgaacctgagacgctcagaccgccgaagacttcgggcagccgtacaccataggtgcgtgggacgacccgccgaatggcatggaagggccatggacgaccatgcactggagggccgtatcgcacttcttgccatggttgatagaaaagaagctgacctcctgctggccaggctcaggagccaagcatctggatggcgatcccgggacgcctga

SEQ ID NO: 14066 - RNA, 2823 nt, unidentified
  source 1..2823: mol_type = other RNA; note = synthetic construct
atgagtagccggttttccctgccctctcttctgctgagttcaaatgaggacagctacttcgccttcctaagagccctgcctgtggagcagaatctgacaagccaggacatactggcgttgtgtaaaaaattagactggcgaagcctagattcagcgtccaagtgccaggccctgctgacccagctggttaaggatagctccgctgacttcgaggaactggcgcatgacattgacattagcagccagtctttttggcggaaccttctggcgtgctccgaagcttccacacggcctggcctacaatttcttatcgaggctaacgaagcctggggaaatgaggtgctgggcagtaatcaagcaaagatcatggacgacctaccagctaataaaattgtcaatgcactgatgaccctattagtggaccccgctcgtctgacctctacgcagcttggcttgatcgccccaagacagagggccgcatgccttcatcactatctcaggcagcgggtccccgccgctaggaaaaagaaaaacctggaactcctgcctattttccgaagtgcccgaaaaatttatggcccagaagccaatccccgagtggtgcttctcgcagtgcaacgggcccttattagacaatccctctccgcgaaaaaaattggtaagcgcgaattcctgatgctggacgacggcctgcaatccgcactgactgcttcccccgtgctgctggacagatttgtagcctcccagtatcggcacgtgctaatctctatgcggagacagatcgtgcgcgtgaagaaactgcccatattggacctcacccatacaatccagagtctcgagagcgggaatctgagtaacaaactgattccggcattagaattttggcgcttcgtaagacccgatttcagtaaactcgtggttaactctctcctgaaaatcgccgacacgtctgaaatcactcagagtacggcccttgctcagtggtgtggaacaacctcatatgacatgtcgatcgggtttctcagtgttctgtcagcatttgcaccgctggaaaagttcctcagttacccggataggacacggagagatattgcctataagatgaacgccaaactgttgctcttggtgttgagggcaggccccgtccctgagattggccatgtcgcaaaactggctgccaagaagccgggcatcctcagggcctggctgacagaatgggatcgctggcagaaagatgaggatatctcatacggaatgtccctcatgtctgaaatcattgctaacagtcggcaggtggatgtccactggcgagtgttagagcggcagatcgcctcgttacctctatcaaccttaagcattttcctttccagcgataattcgaaattccacaacgggacacgcaatcagtcacgtctgataaaactgatgttacagagctggcgccgtggtcaaaagcacgataatgctcagcgcctgctgaagatatgtcgccgccacgggcgcacgatattggaagtagcaggcgatagcctaaccgcaatggagatcagatgcatagccggttcaaagtacctcggcgagctccggaaaattatcgcaagccgtagccagaagattcctgggtggcggcaattcgtgactgtatcccttctcaaagcggaacgcgcaccttacctccttaatcggataatcgagggaaacccacacctggtcgccgaagccttccacgtgcgtcccgatttggtgaggtggaaagatgtggaattggtggaccctaacgacctagttcatgccgccactcactctaagaagtttgccagaaagctggaccttaggttgactgaccggcgacgtaggagcctcttaccagtcatcagggctctctatggcaataaacctcgctcctgtgcggcctacgagctggctatgctgacagagctgaagttgtctagaacatttgtgtcactcgcactgatgctggctcacgccaaccaagttcccgagggaaatactttcaacgcgttttacaagacatataagttgccaaagaagtctggggggagcaggaccataactgccccctccacaatgcttaaagccgtgcagagagggctgctgaagaaggccatcgccccaatggacaacagcccttctgcaacaggattcaggaagggatcatctattgtgaagaatgcgcaggaacacgttaatcagaaaatcgtcgtcaacgttgacattaccgcattttttccaaacacccgctactcgctgatcagacaagtggctgctcaggccgttgatgggcatttgagccccatcgctcaatggcttttggctgagatttgctcctatcagggagctctccctaccggtgcacccacttctcctgcagttggcaatatcgtcctcaagcgagccgatgcaaccatcgccaaggctgcagagcaccgacggattaagtacacccggtacgctgacgatctcactttttcaggtgaggatggagtcgttgatatacttccactcgtagtgagaaccttaggggcctgggggtacgagctggacaacaagaagaccaacatcttcagaaggggtaggcgccagatcgtaactggactggtggtcaacgagaaaccgaacatggctaagccattgagaaggaggcttagatctgccgtacatcgacgcctgtccggcagacagccctcttggcatggcaagccaatgagcgactcagagctgttgggtaggattgcgttcctcgcccagacgcagccagctgaggctaaaaagttaagggatcaactggaggctgtccagtga

SEQ ID NO: 14067 - RNA, 3984 nt, unidentified
  source 1..3984: mol_type = other RNA; note = synthetic construct
atgctggtggtggtggaggtggctaaatggcggactcagaaagaagctaatatgctgaatgggtacaggcgccctaacagcatggcttcacagcaaggggagcagtgcattcagtcagtccccttctgtagcacactgcccaatattacatccggacttaagcactgggagatggactgtgtcagaccatctacttattttaagagcattgctctccagctgtggacagaactgcaaattgacaagaacttcgcaaaggaactgcagcgcaaccacaggtccgccaatggacttcagtgtgtgcgctacttgcacgccacagcaaaatcggacgctgatcgcgctctgacgtggttgtttgcgacccacctcctcccaagctggaagcttccacagcccatgctccctatgctgctggcccaactgcagcgggagtacaaagacgtggctttggtgcaggccattatgcgcatggcagatcagtctgttaaggccggagaggctggaagagcctttgaccacgagctggatcacgagttcgaccatgcgcccgaggcgctggtatttgtggattcagccgacgctcacctgtttctggaggccgctaataagaagtgctccgcggacgctccactctggatgtgcctgtcgacttgtgtacgaccggacagaaacgccgcaaacggcgcatgcgcatgcccatgccacgcactggagccactcagccagctgcggaggctctattctctgcttgcacgcgctcatcgtcgcgtccctcagggaaaaaacgccttcgaattggaaactttactatctgtgacagacctttcaactccgaaccctacggctcacgggccagtggacctgagacagacatcgcatgtggcgcacaaccgtatcgaccgatttggcctggatttcatcatcaatcaactgccttttgggtcagtgattgccggtcctctgaggcgagcaatgctggataccgtgttcctgggcgaatttgcccctttcctggattcaatagccaatgaggcaccccctgcgggccgaatgagacagctcaccgatcggcagatctcccacgcacactcactgcgggtgcgccataggaatgagtgggattctgctatcggtgctaccctggacttagttaccgctaggtccaccgacgccatacctgccgactctaatgccatccaggaagactgttggaatcacctccgcattgtggatgcaatcctgcatgaggctaacccccgccgcagaataggagagtatctaaggcggatcgttgccagagaagggccggcattgcagccagacgccgctactaagtgtcagcccacagagcctctgctggaagccatggagctcattggccgggcactcatcctgagggagctgcgatctacggtgggcggtccgaaaccactcacttctaccagcaccatgggcctgttggggcgttttgccatgcccagtgagtctattagcaactccctcaagctcaaccttccagaccctcccatcgctgcaaccccttctgcacctgaaggtccctggtacagaaggcaggcaaatgatcctaagcacactaatttggacagcattaagcattgtcttagatgcctctacggctgccggagcgatgccatcatgctatccattgcctctgtctttgacggacccactaaagcagttgcaatggccacttctggaaattggttgaaaccaggtgccctggctagatggatgcgtaccagttccataccttcttccaaccgttttgattttgtccgacagcttacgttgacccacggcgataaacttgataagctcttgcctatgttcgcccgcgaaaggacctgggacgaccatcggcccctgttcaaagggcagcaacgtccaactaacgcaacggagcaatggctcgtgcagagtatcgagttgccccccaagagtcttgccttattatcaccccgcgcccggaaggcctatctggcaaatttcatcagacggtacggcgacctggccacaaaattcctcgcaccgaatttccagtctagaatacagcgggaaaagaatggacagctggactttgctggcaatgccttaggaacagtggcgtgtgccgttaacgaactcccctggcggacagttcgagctgcccttcctctgcatgttattgaaacggttatctcggaatccaaattcggggccgctagagtccccgcaagtgtacctccatctgtgcccccctcagtgccacttgctgacgtcaagaagctgttctcttaccatggtgaatccgctctagtagtctgggcacgcgcgtggcaccgaatagtcagctcagctgctactacccaatccgggaaggcccgcgcaaccaaggccctaatccgcaatatcagcaagggaaagttcaacctgcaatgcttttgtgagctggcaagccagccgcccagtgcctcaaaaagtaagaagcggtttgtgtccgattttgccacaacaatcttggccatcccagctatcgtgcaggctctggtaagccaaagcaagagtctcgaccaaacctggttcctcctgcaaaacagcagaggacacgccttggccgatctcccccgaagccagcttgagaacttcgtgctgtccattgacagtgaccttagggacatttcagatggtcccccgggcgattccccagctgatgcaaagaaactgaaccggccttacaggaaggctctgcggtcgcctttgaattttgtggcccagtttgtggatgtgatagcaaggaggctgtgtacagtgtccgcaagcgacgatgccgccattaccgcacaaaaaattgatctggcccgcctcctgctaagggtaatcgctacccgggagcttagagcgccagctagtgttgaaaccatagagcttctgacacagcggctatcaactcgccgggacgctcagttaaccagaaaagccgcccaaggaaggtgcaaacccctgaaagagccagccgaggaaactaccgtgctcgctgtcgcactcgaacttgcaaaacagggcctggccgacgaattccagcaagtgttaatgatcacccggactgctagtctcgatgatcgatatcgtgcccacagaattcctaaaaaacgggggggaatgagggaaatccaccagccggatgctgatctaatgcgtttacagagaaaggtcttggcgcgctttctcgcacgcgctccaatcagtgagcatgcgcacggtttcgtcagaggcaggggcatactcacaaatgcgctggagcataccgggaaaagagtcgtgctgaatgtggatattcggaacttctttgggagcctcccaatcgaacatatcagggccgcgcttaaccagactagactgcgcagccaggtgccaaagacagagaaccaggggtgggccgtcagagacagggagagcctgtcaccagccgcgttggatgtactggttaaaatcgttacccgtgccggatctttacctcaaggcgcgccgacttccccagccatcacaaacattgccctgcgccacacagacggtatattggctaaagcatgcagaagaattggcgttagctatacgagatatgctgacgatcttactttctccggcgccgatggccccgttcaagggattgtcccattcgtacgggaactgctgacgaggatcggtctagagctacatcctgacaagacacatgtataccgaagcggccgacagcagttagtgacaggcttggtggtcaacagttggcccaatctacccagacgggataggaggcggatgcgtgcagctgcccataggctgggaaccaccggtaaggccctgaggtggaaagggtcccctatgtctttggccggcttccaggggaggttatccctccttaacatggtcgacgagagtcgagccgactccctcaggttattggcgaagatggaacccagatga

SEQ ID NO: 14068 - RNA, 954 nt, unidentified
  source 1..954: mol_type = other RNA; note = synthetic construct
atgtcgactattacatcatttacactcccaacatctttgcaagcccttgcaccgggggtggggaaacggtaccatgtctaccctctagtcagcgggaacaataagaagaagaagcgatggatagaggcgcccgacagcgaactgaaagccgctcagagatggcttctggacaactggctgtatcacctcccacccaccggctttgcacacggattcgtgccgggtaggagcattctcacaaacgccgcggagcatgtcggtaggagatgggtcgtcactgccgacgtaagagatttctttccctcaataactgccggaagaatcgccacctgcctcgccgagctagaactggacgccgctgatcgctccactgtggtgcagctggttacgcgtaggggacgcttgcctcagggagctcctacgtccccacaccttgcaaatctagtggcccgtaccctggatctccggttgtctggcttggctcgccagcatgactggacctatactaggtatgctgatgacctgactttctcagcgggttccccaaccagtccagataccggaatgccccctcacgaattattatgggcaatcgaacgcatcgttagcgatgaggacttccagctggccgcagacaaaacccacgtaatgccccaccaccagcggcagaccgttacaggcctggtggtgaatcaacgggtggctctccccaaacctagacgcaggaccctgcgagcaatgctgcacaggctggagacgagtggccctgagacactggatctgcgtcaattacaggtggcccaggggcatctggccctcagtaagttgatcgacccagacggttacgatcttgcctgtagacatcttggcgaactgattcgaaactctgttgcaggctctgctctggggactgctgtggatagcggctccacagctaccacacggctcgactga

SEQ ID NO: 14069 - RNA, 1038 nt, unidentified
  source 1..1038: mol_type = other RNA; note = synthetic construct
atgtccactagagcccagcgggcacatcctggcccactctttctgctccgggacaggaccgatccacgctgtcaccgaagagccctgattgacgcacatcgcaaacaccgtcccaacccacttaccaccacactcactagccttcctgattcactactggctctcgccggcgatacagagagacggtatcaggtgtaccccctggtgaatggcagcaagaggagatggatcgaggccccagatagagagctcaaagccgcacagaggtggctgctggaccactggctgtaccaactggctccaacggacgctgcccacggattcgtccgaggacggtctatagtcagtaacgctggacaccacgtaggccgggactgggtggtcactgccgatctttctaacttcttcccatccattggtgcggatcgcgtgtcacaggtgattgccgggctggatctcaacgcaaatgcctccgacgcagtggtccgattggtgacaaggcggcgacgtctgccccaaggtgcaccaaccagtccgcatctcgctaacctcgttgcccggcggctggacttacggttgatcgggtgggcgcgaaggggaggatggaattacactagatatgccgatgatctaaccttttcgggtgaggggaatcccaggacactactgttgactgtagagagaatcgttcaggacgaagggtttacattagctcctggcaagactcatgtgatgcccagacatcagcgccagctggtcacggggatggtggtgaacgaacgcgttacgcttcctaagcctcgccgcagacttctcagggcgatgttgcaccgcctgcaaaccacaggcgcagacgctgtggaccctggtcagctgcagatagctcagggccatttggcactggcccactttgttgacccggaaaggttccaggccgaatgcagggctctggccgacttacttcgtggggaggcgagcccccaagctgatacccctaatcccacagtatgcacccccatcgataagaaagtcgactga

SEQ ID NO: 14070 - RNA, 939 nt, unidentified
  source 1..939: mol_type = other RNA; note = synthetic construct
atgcccaccgagtatatgtccgactttatgcccacaactctgccatgcccacccgctgcagtgctcgctctagctgactctgcagagcagagataccgggtgtacccactgatgtcaggaagtaaaaggcgctggattgaggctcccgatcaggagctcaagactgcgcagcgctggctgcttgaccagtggctctatcagctggcacctaccgatgccgctcatggcttcgtcccgggtcgatccatagtatcaaatgccgcacggcatgtgggatgtgcctgggtggtcacagccgaccttagaaactttttccctagcatcggggcgagcagagttgctcaagtgctcacagagtttgagcagcctgcagacgtaactgccgccttagtgcgtcttgtgacccgacgtcaacggctcccgcaaggtgcacccacttcgccacagctggctaatttagtcgccaggcggctagaccttcgacttttgggctgggcccgccgttcaggatggaactacacacgctatgccgatgacctgacttttagcggagccgggaatccacggcctttactggaggcactgaagcagatcgttcgggatgaaggcttcaccttggcgcccgggaaaacgcacatgatgagtcaccaccagcgccaggtggttaccggcatggtagttaacgaaagggttgccctgcctaagccgcacaggaggttgctgagagccatgctctaccgcctggaaaccatgggggtggataaggtcgacccacaacaactgcaggtggtccagggccatctggccttggctcacttcgtcgatcccgccaggtttgaggcggaatgcagagccctcgcaaccttgctaagagaagctagctcttccctgcctgctacagcctccagttctttcgtgcctgcagtgacgaaaacatga

SEQ ID NO: 14071 - RNA, 924 nt, unidentified
  source 1..924: mol_type = other RNA; note = synthetic construct
atgaacagaagcgccttcgaccccggagtgaatgagacatcaggcgacctcatcgacctggtcgagagcctgaacgttcccctgcaacgactgtccgaaatagcagcgacagcaaacgagcggtatgacgtctacccactggttatcgggaaaaagaagcgctggattgaggccccaagagataagttgaaacagttacagcggcggctgctcgacagtgtgttctacaggctcgtacctcatgagtcggctcacgggtttgtcagaggccgatctattgtctccaacgctaggcgtcattgcggcagaagatgggtggtgactatggacatccgggatttctttccatcaatcggcgccgagagggtgaatcgtcaactcctgagcctgccaatgacagacgccgaacgcgagattgttgtaaagcttgtgaccaggaacgccaggctccctcagggagctcctacctcccctcacctcgctaaccttgtctctcggcggctagatatccgactgcgccgtctggccgatgaagcaggttggacatataccagatatgccgacgatctcgcttttagcggagaaggccgccccaagcaactgatcaggatcgtggaacagatcatacaggacgaggggtttcagcccgcaaggcagaaaacccgcgtgatgtccagacaccaaagacagattgtcactggacttattgtgaatgagaaggtggccctgccacgccccaaacggagactgttgcgagccatgctacaccggttgaggagtaccaatgagccgctttctagtttgcctgatatacgagtaatccacggtcatttagcattagctacgttcattgatccggatggttaccgcgaaacttgcaatcaggttgcgcagctgattgaagggaggtgttcattcgtgtga

SEQ ID NO: 14072 - RNA, 924 nt, unidentified
  source 1..924: mol_type = other RNA; note = synthetic construct
atgggaaatgccttaagcgaatccgaaaacgggcgcaccgccggagactcgattaggcttgcggagattttatctgcaccacccgagcgactgaacgaaatcctggcaagtgctgatgaactctatcgcgtctaccctttgattaagggccgcaagaaaagatggatagaggctcccaggagcgaactgaaaaggctacaaaggcgtctactggactcagtactttatcggctggtgacagatgaatccgcccacggctttgtccggggtagaagtatcgtcactaacgccagaagacactgtgggcgggcctgggttgtgaccatggatatccgggatttcttcccaagcataggagctgagagggttgaccgccaactcgtgtctctccccatgacggaagtggaaagggagaatctcgtgaggctggtggtgcggaatgggagattgccccaaggcgctcctacttccccacacctggcaaatcttgtatcacgacgattggacctgagactcaaacgcctggccgagacaaccggctggacatacacccgctacgctgacgatctcactttctctggcgagggcaagccaggtaagcttgtccagattgtcgagaatattatcgttgacgaggggtttcagccggcctgtcgaaagacccgggtcatgagcagacatcagcgacaggtggtgacaggtctagttgttaacgataaagtggccttgccgaggcctaagcggagattgctgcgtgcaatgttacatcatctgtcatccgccaaccaggacagtgtatgcctccccgatatccacgtgatccacgggcatctggctcttgcggccctggtcgaccctgatggatatcggctgacgtgccgtcaggtggcacagctggtggagaaccgctacgacgacgcgtga

SEQ ID NO: 14073 - RNA, 1065 nt, unidentified
  source 1..1065: mol_type = other RNA; note = synthetic construct
atgacaaaggctaacctgcccactaatggctgcgatgatctggctaatctcctggacctcgacccaaacagactgacacagttagcaggagaggctgtcaatctctacgagaggttccctctgaaaacccgaagacgacggccccgttggattgaagcgccaaagccgtttttaaaattggtgcagcggcgtctcttggaccggctgctctacgccaccccacctcatagtgccgcccatggcttctaccccgagctgtcaatactcacgaacgccagaattcatgtgggatccgcatgggtagtctcctacgacttggaggatttttttcccaccaccgatctcgacaaggtacgcagtgtgctgaataagaggtacgatgtggaagaaggcgtgcttgaaagcatcatccgattgacctgtaggaacggcaacctaccccagggcgctcctaccagtcctcacctagctaacctggccttctaccagggcgacgaactgctgtcagagctagcaaaacagcacgatttaggatatacaaggtatgccgacgatatgacattctctgggaaggagcttccggcggagctcgatgatgaggtgaggcagattgtccaccgagtggggtatcggctggctgaaaaaaaaactaagcgcatgggtcggcaccagtgccaaaaggtgacgggattggtggttaatgagggggtccgcctgccacggaagcaaagacgcagactgagagccatcaggaatgacatcgccatgatggggatggaaagcgcccttgcccgctcagggtatggaagcgtatgccagctccaaggacatcttgcatttgagcgcatgacaaataaatctaacggtgtttctcgtggactgcagaatctgcggcctaaaaacgcgcttgcaggccagccacctgttgaacccgaagataaggacggcggtcttcctcccccctcttgtccgagcgtgagaaggaggcaatccgctgaccacggcggtactccacaacagatgccagactcggagctggagtccactgttcagactgtcgggtga

SEQ ID NO: 14074 - RNA, 921 nt, unidentified
  source 1..921: mol_type = other RNA; note = synthetic construct
atgcgcactacagaaacgcactccgttatcgtgcaggacatggacatctacccagaagcggatgccgtacctccgccactgacaagcgctgatctggcgaagtcactccatctcagtgaggagcgtctggtgagtctgctttcgtcagcagagaaatcttacaacagatttcccctgaagtgtgggcggagaaggcctaggtggattgaggctcctaatccatttctgaagcacgtgcagcggtgtctgcttgacaagattctgtataccgtcgtcccacatcccagtgcacacggatttcaacctgggagatctatcgtaagcaacgcaagaatgcactcttgccgggagtgggtcctatctatggacatgaaagacttctttcccaccaccgacattcatatggtggagaaaatgctgcaagagcatttcaacttcactcaggaaaccatagaggcgatcctccgattgacctgcagacgcaacgctcttccacaaggagcccctacctccccccatttggcaaatctagtgtttatggagggggatcggcgccttacggcaatggccatcgagcacggcatgacttatacaaggtacgccgatgatatgactttctcaggagacactctgcccgaagatatcgaggagcaggtcgaattaatagcccaggaagctggttatcggatttccaggcacaaaacccgccgaatgggccagcaccagtgccagaaagtcacaggtctggtggtgaatgaaggcgtgaggctcccgcgcgggaagagaagacgcttgcgtgccattctcaacgatgttcgaaagaatggcatggacgctgccttagctcggtccggcttcaggagcgccgacgaattgagcggtcacctggccctcgccaggatggttggaacagtgcagtga

SEQ ID NO: 14075 - RNA, 939 nt, unidentified
  source 1..939: mol_type = other RNA; note = synthetic construct
atgctaaaagatctacagcatcctctcgaactgtcaaccgccgagctccagcctttcgctagccgcattggctttccaactgatgtgttatttgacatcctgtccaaaaaagaagaccaatactacagattccccataagcaaaaggaatggtaagaaccgctggatagaggcccccaagaatgagctgaagagtatccagaaacagctcttgctgcaaattctctatgaacagaaggctcattccgcagcacacggatttgtgcccaatagaagtattttgactaacgccaagcctcatgttggccagaattgggtcgtcaactttgacatcagtaacttcttttcgagcacccaaattcacctgatccacaaagtgcttcagacataccctactctctcaaagcgggaacagcacataatcttcacacttatctccaaggataacacgttgccccaaggagctccaacctcaccgcatattgctaaccttgtactttatgactttgaccacttcatatctgattatgcgcagaagcatcagctcgcctacacaaggtacgcagacgatctgacattctctggggaccagattccgaaggagcttccactgatcgtgaaaaagcgactgaaggaggatgggtatcacctggcccagcacaaaacctcatggacggggaagcataagaggcagctggtcaccggcctggttgtgaatgacaagatcaacttaccccgcccaatgcgtcggcagatgagagcaatcattcactccattaaaacaaatggcagcatcaaagcattcgctaccagctcttggtccagcgatcagctctacggtcggattgctctgcaggccatgtgggactctgaagccgcggagaaacaactgcgagagctgttgggagcccaagagttagattggactgcctatatctga

SEQ ID NO: 14076 - RNA, 1176 nt, unidentified
  source 1..1176: mol_type = other RNA; note = synthetic construct
atgcccgttatcgataaggtggatgaattcaagatgatgtttaacggcgtgaaggacccagtaggaatctttgacttctgcggggttaacgcagagcgcgccttgaccgaaaagagtaaagacgctgaactggtcgagaaactcaatcaatttctggacggtcagttcttcaccagccactcaatagatcgtctcgcgcgggtggttggtgagggtactgatatcattagactggccaaagtaggctacagaggctccatctatatgttaaacgaatcggtggaccagtttgctgaactgtctgaggctatcggcttccctaaggaaatcattcagcagtacgtgtctgatacagcttcccattatagtcgctttttcatttggaaggatgaggctaagaccaaaaagcgatggatcgaggcccctgacgataccctgaaacaaatgcaggaggccattttaaggaatattctctacaaaatcgcccccacgaaatttgcgcacgggtttatttgtggccgcagtattgtcacatgcgccaaggcgcacacggggaagaagtttgtcttgaagctcgacctgaagaacttctttccatctataactagggaaatgctgcttggagccatggcaccctatataaacgaatccaactttaagttcgtcttgcccgccatggagctgtgtttaatggagggaagactaccacaaggggcacctactagcccggccgcaagcaatatcgtggctcgtcagctggaccttcttatgtacggaatctcctctcagtttggctgcgagtatacacggtacgctgacgatctaatattcagctcaaatgagagggacatctataccatgataccgatcatcaagaaggctatcgcaaaattcggcctggtggtgaatgagaaaaaggtgaaagttctgaaaagccatcaacggcagactgtgactgggctcgtcgtaaattcagatgggcagacatccgtggcccgaagaaaacggatgaaactccgcgcattcattcatcacattttgacaggtcggtacccactggatcgagtcaactttgccaggcttaagggaaatatcaccttcattgccatggcaaatcctaaccagggcaggtggttcctggagaaatgggacgaaattcaggccatgagaggatga

SEQ ID NO: 14077 - RNA, 927 nt, unidentified
  source 1..927: mol_type = other RNA; note = synthetic construct
atgtttggctggtggcgacgcaggaaagagcgtaggcaactgactgagaagttgctgttcatcaaccggaacatcgccccacactatcattctttccccctcaaaaaggccacaggcgggtaccggacgatcgaagctccagtggaggagctgaaggaagcgcagagactcattctgaagaggtattactatggacttgagtgcagcacagccgctcatgggtttgttagggggcgatccattaccacatgtgcccggcaccattgcgatagactcgtggttgtagctgtagacatcaaagacttcttccccagcatcaccagagacatggtggagaagattacccgcgatatggtcccagagctcgcaaaaaataaggaactgttcgatctggtgttgggagcgattacaagcaatgatgccttacctcagggatcccctgcttctcccactttgagcaacctagtttttaacggaattgacaatcagctggtgagtcttgcctgcgcctttaaagccaggtactcccgttatgcagacgatctcttctttagctctcggtacaaccgaaatctgcctggcataattagttcagtggaacgcatcctaaatgcgcacggattctcgataaataggaaaaaggtgcgcgtgatgagaagaggccagcgtcaggtcgtcgctgggttaatagtcaacggcaaaactcccgccgtgggtcgagaacaactgagatcacttcgcgccgctattcacctgttggagaaggaacttcagggcgcaggtccacagagcccgagtgttgcaaagctgatggagtcaatccaaggtaaaatctctttctttcacatggtcaaccctcagtcagtgcggagactcgctcgcacctttaaggcaatctgtaggcagcaagcagcccggtcctcctga

SEQ ID NO: 14078 - RNA, 927 nt, unidentified
  source 1..927: mol_type = other RNA; note = synthetic construct
atggttgatctactgcccctgctagtgaaggaaggagcaatggaggagtccagataccgcatgtatcggatcagaaaggccaacagacgctttaggacgattatggagcctgacccagctcttaaaagtctgcagcgctccatcttgagatggctgatggccaggaggatcagggcttctaagtacgcacatgggttcgtaaaggggcgtagcaccacaacaaacgcagccctgcacgtcggtaaacgggtggtggtccgaatagatattcaggacttctttcctaccatcacagagcgccaggtaaagtacgcgctgaccagagaggggctcctttctgatgatgcggcccgaatcgccgacctgtgcactgtggaaggcaaactcccacaaggcgctcccacctcccccttcctgagcaatatgatatttcgtgtgctcgactaccgactggccggtctggccaagaagtggggtgcaacctattcgcgctatgcagacgacttaatattcagttcagatcgggatgacttgcaggctatttaccacccagtcgcttcaatcctcgaggaagacggattcgaggttaaccctgataaatttcgggtttaccgtagcacaagaagacaacgcgtaacgggcattgtggtgaatcaccatccaactctgcctcgggaatctagaaggcggcttagggctgcactgcaccatgttcgcaggtctattgtgactggagaggaagtccccgccgagcgcttggacagcatcgaagggagcgccgcgtatttaacaggcattgaccgggagagaggccggcggttattggtggaagtccgagatctcaaagcactgctcgcccttcgcactagaatggtgagtaggaggcgaccgaggcgtacctcaggaatcgctgccgctccgtcctga

SEQ ID NO: 14079 - RNA, 963 nt, unidentified
  source 1..963: mol_type = other RNA; note = synthetic construct
atgaatgccgctcccttattagtctccttctataccttgtctaaattcctggacgcactgccagagaagcatcggaattcctaccaacgtcagatcgaaaatctcttcgctcagagccttccgccatgtgtatccgaaatttgcctggccgtgctgttcgggtattcagtggattttgtctacgccctgagcaagaaccagcataagttttacaggtccttccagatcagacagggacggaaaactcgcaccatacatagtccaagagtagcactgaaggtggttcagaagtggttgggagtgcacctgtcggatgcaattacattcgagcctcacgtgtgtggctttgtgaagggtaagagctttgctgatgctgctaaaattcaccaaggagccaagtgggtttactctgtcgacattgaaaactttttccctagtatcacgattctccagatatccaatgcgctggaaaaactcggctatacaaaggaatcagcagagttgctggcaaatatttgctcactcaactccactttagctcaaggcagccccgccagtcccgtcatcagcaacattgtgatgaaagacatcgatctccagctgaaagagctagcggacaagtacgagctgcaggtgagcagatacgccgatgacatcgtgtttagcgggaccgagcctttcaacgaggggatccccaaagacctgaataccctctttaattctacctcattcactctgaacaagaacaagacctatttttctgacagtgaaaagggtcagcgccttaaagttcatggccttctcgtcaaaaaagataagatacgacttacgaaagggtatcgcaataaaatcagggccttccggcacatgctggaaaaggagaaagtgtctgagaacgacttgcaacgattgaagggccacctaacattcgccgagtttatcgaaaggaagaaccaggtttga

SEQ ID NO: 14080 - RNA, 963 nt, unidentified
  source 1..963: mol_type = other RNA; note = synthetic construct
atgaatgcagccccactgttggtgtccttcgataccttgaagaagtttttagatgccctgcctgaaaagcaccgcaaaagctaccagcagcagatcgaaaaattattcacacagagcctgcctcctagtgtcagcgagacatgcctggctgtgctctttggttactcagtcgattttgtgtatgcgttgtcaaagaagcagcacaagttctatcggtccttcaaaataaagcagggaaagaaagtccgtatcatccatagcccgcgagtggctctgaaagttgtgcagaaatggttagggacgcatctgagcaatgctatcagtttcgagcctcacgtatgcgggtttgttaaaggaaagtcgtttgcggacgccgccaagatccaccaaggtgccagatgggtatactctgtcgacattgagaatttcttcccaagtataaccgtggtgcagatttcaggcgctctcgaaaaacttggctactctgaggagtccgctaaattcctcgctaacatctgttcgctgaacgggactcttgcacaagggtccccagcctctcccgtgattagcaacattataatgaaggacatcgaccagaggctgatcgaactggcagagaagtatgtgctgaaagtctccaggtatgccgatgatatcgtattttccgggaaggaacccttcagcacagacatacccaacgagctatctagtatttttggactgacccccttcctgcttaataagaacaaggcctactttgccgactcacagaagggccaacggctcaaagtgcatggcctcctagttaaggaggacaagattctgttgaccaaaggttacagaaataaaattcgggcgtttagacatatggtcgcacagggcaaggtgtctgagggcgatctcccaaggcttaaaggacacctcactttcgcagaatttatcgaacgcaacaatcaagtttga

SEQ ID NO: 14081 - RNA, 963 nt, unidentified
  source 1..963: mol_type = other RNA; note = synthetic construct
atgaatgccgcccccctgctggtgtctttcaactctttcaataagttcctggaggccttgcctgtgaaccacagaaccgcctgcaagcaagagctcgaagagatttacggaaagtctcttccaatcggaatcagcgaggtgtgcatcgcagttcttttcggctactccctggatttcgtctatgccctgtcaaagaagcagcacaagttttatagatcgtttcagatcaagcaggggaaaaaaactcgtaccattcattccccgagggtggctctgaaggtggtccagaaatggctcggcgctcatctgagttcagcattagtgtttgaagaccacgtttatgggttcgtcaaaggtaagtccttcgttgatgcagcgaaaagccatcagggtgctaagtgggtgtactctgtcgatattgagaactttttcagtagcatcaccgacctccaaatctctgaagcatttaaagagttgggatacagtcacggctctgccacactcctgagtaatatttgttccctcaacagtaaactggcccaagggtcacctgctagccccgtcattagcaatctagtaatgaaagacgtggatgccgggctgaaggcgatggctaataaatacggactgcaggtgagccgatatgccgacgacatcgtattgtcagggaaggcagaattcaaatccgaaattgccggcgagctgcatagcatctttgaggccacgactttctcccttaacacagacaagacttactttgcagatgctgaaaaaggtcaacgcctcaaaatacacggcttattagtgaaggaggatacagtcatactaacaaagggctatcgcaataagatacgggcgtttcggcatatggtagagcagggaaaggtgtccgctgacgatcttccaaggctgaaaggccacttgaagtttgctgaatacgttcagaggcagaacgacacctga

SEQ ID NO: 14082 - RNA, 1119 nt, unidentified
  source 1..1119: mol_type = other RNA; note = synthetic construct
atgcaaaaaagaagtggcgaggaactatctcgcgggtgcgcctcatgtcctttcgcaaaggcccgacataggaacacggatggccagactagtattcgcgcaagccccggctggacctttgttcaccgatgcaagttcttcgaaaaatatagcgtgatgaacgcggctcctctcttggtgagcttcaattcgctgtccaagtttcttgatgctctgccagaaaagcacagggaaaacaatggagatcagatcgagagtctcgttgacaagtcacttccccccgtcgtgtctgaaacatgtctcgctgtcctcttcggttattccctggattttgtctacgccctctctaaaaagcagcataaattttaccggtccttcaaaattcagcaaggcaaaaaggttcggaccattcattctccacgtgtagccctcaaagtggtgcaaaaatggttcggagcccatttaagcaatgcagtgtcatttgagtctcatgtatgcggcttcgtgaaggggaagagctttgcggacgccgctaaaatccaccagggtgccaaatgggtatactccgtggatatagaagacttcttccctagtatcagcacctttcagatatccaacgcattggagagtgtgggatatagcaaggatgccgcgcagctgctggccgacatcagctctctgaatttcaagttagcccaggggtccccagcatcgcccgtgttatctaatatcgtcatgaaggacattgacaagcaactaaaagagctggctaaccagtacgacctgcaagtcactcggtatgccgatgatatcgtgttttcaggaaaaggtgtttttcaggaagcattgcctaccgagcttgaagctatctttgaggggacaacattttccctgaataagaacaagacatacttcgctgacagcgagaaggggcagaggttgaaaattcacggtctactggttaaggaggacaagataactcttaccaagggatacagaaacaaaattcgcgcatttagacacatggtcgagcagggcaaggtgtccgaggacgatctgccgagactgaagggccacctgaggttcgccgagttcatcgcttcaaaaaacgaaaattga

SEQ ID NO: 14083 - RNA, 966 nt, unidentified
  source 1..966: mol_type = other RNA; note = synthetic construct
atgaatgcagcccccttactcgtgtctttcaatagcatggacaaattcatcgaatctttccctaggagccaggtagagaaatacagacagaacattcagtttctgtatgagaattcactgcctcctgccgtttctgccccctgtctggcggtgctgtttggctactccacagactttgtatacgccctgtctaaaaaccagtacaagttctataggaccttccaaatcaagcatggcaaaaaactgcgaaccattcactcgccccgcgtggccctaaaagtcgtgcaaaagtggctcgggtaccatctgtcaagcgctatttcttttgacagccatgtctgcgggtttattaagggccgtagctttgtggatgctgctaagatgcacgagggtgccaagtgggtgtacagcgtcgacatcgcagatttctttccctccgtgtcctccgagcaggtcacagaagcattggtatcaataggttatttcagtgaatccgctgagcttatcgcaaatctatgcagtcttgatgaggttctgccacaagggtcaccagcgtcccctgttttatctaacctggtgatgaaggatatggacaaagagctgcttcacctggctgacaaacacggactcaaggtcacccggtatgccgatgatatcgtctttagtggccgcgataacttcatcgaagaactcccggaagccttagacagtattttcgagcagtccacttttagcttgaatcgggacaagactttttttgctgatgccgagaagggacaacggcttaaggttcacggactgttggtgaaggacgatcaggtgacactgacgaaagggtacagaaataagataagagcattcaggtatatgctcgaccagggaaaagtgtcggaggaagatatcccacgactccagggccatttgaagttcttcgagttcataaacgaaaagaacaaaaacgactga

SEQ ID NO: 14084 - RNA, 966 nt, unidentified
  source 1..966: mol_type = other RNA; note = synthetic construct
atgaatgccgcaccactgttagtcagcttcaacagcatgaataagcttatcgaaagtctccctttatcacaggtggagaagtatcagcagaacatccaattcctgtacgagaagtcactgccccctgtggtaagcgtaccctgtcttgctgtgctgtttggatactctacggactttgtttacgctttgtccaaatcccagtataaattctaccgttcctttcagatcaaccacggcaagaagctcagaactattcactctccaagggtcgcgctcaaagtggtgcagaagtggctagggcaccaccttagtggagccatcagtttcgattcccacgtttgtggcttcgtgaaaggtagaagttttgtggatgcggccaaagttcatgaaggcgcaaagtgggtgtattcggtcgacattgtggacttctttagctccatttctaaacagcaagtgtccgaggctctggtgaacatagggtaccttcccgagagctcagaactgatagcaaatttgtgcaccctggataatgttctacctcaaggtagcccggcctcaccagtcctctctaacctggtcatgaaagatattgaccgccatctgcagtatctggcagacaaatacggcttgaaggtgtccaggtatgccgatgatatcgtcttttcggggacagacgccttctctgacgaactgcccttggatctggaggccctctttgaaccaaccgctttctctctgaaccgggataaaactttctttgcagacgctgacaagggacagcggctgaaggttcatggccttctcgtaaaagatgacaaggtgacactcaccaagggatacagaaataaaatcagggccttccgacatatgttagagcaggggaaggtctgcgaggaagacatgcctcgcctgcaaggtcacttgaagttctttgagtttatcgagagcaagaacattaatcagtga

SEQ ID NO: 14085 - RNA, 1020 nt, unidentified
  source 1..1020: mol_type = other RNA; note = synthetic construct
atggacgcttgcccctccagtaagctgatctatgagatctgtgtcatgaatgctgcaccgctcctggtgagcttcgacagcatcgataaatacttagaggcgctgcccgaaaaacaccggacagcccactcagccgcgttgtctgatcttttttcaagaggtattcccccaatcacatccgcctactgcctggccattctttttggatatagcctggagttcatttacgcgatgactaagaggcctgataaattctaccgagtgttcagcattaagaatggcaaaaaaacacgaagaatccaggcccctaaggttgctctcaaggtgattcagaaatggtttggtgctcatctgagtaataacctgacttttcatccacacgtttacggatttgtcaagggcaggtctttcgtggatgctgcaaagcatcatatcggggcccgctgggtgctagctgtagatatagacaacttctttcctagcatttctaaagaaagagtgctgttgtccctcattgcccaaggttattctaacgatgccagtaaactcatctcagacctgtgttgcttgaacgactctcttgcacagggcagtcccgcaagcccagttctatccaatctgtgtatgcagtccatagacgactcgctcatcaagctgtccgagaagtataaggtaacagtgaccaggtacgctgacgatatcaccttcagtggcatcggagaattcgatgaggggctgaagcgggatttacaagaattaattaagagctcaggctttcagctcaacgatgacaaaacctattttgccgacagcaccactggaaagcgtcttaaagtccacggcttgctcgtgaaggaggattcggtccgcctgacgaaagggtacaggaacaaaatccggctgtataagcaccttcagaagtccggaagaatttctgaagatgactaccaccgcatcaatgggcatataaatttcgcagacttcatcgactcaatgtccgggataaaggacgccatttga

SEQ ID NO: 14086 - RNA, 966 nt, unidentified
  source 1..966: mol_type = other RNA; note = synthetic construct
atgaacgcaccaccccttctggtgtcattcgctagtatcgacaaatatttggaggcccttcccccccagtacaaaacccagtacgaggatgaaatcaagcgtctgtatactaacggctttcctcccatcgtttctaagctatgtctgggagtgttgttcgggtactcatccgactttatatacatactggcgaagaagcctagcaagttttatagaagcttcactctcaaacaaggcaaaaagacccgaaaaatcttcgctccaaaggtgggtctgaaagtcatccaaaagtggttcgctacgcacctcagcaatgtgattgagttccaccctcacgtccttgggtttgtaaaaggcaagagcttcgcggatgccgctcagctccatattggagcccggtggattttttctgtggatatcgtggacttctttccatctataagtaaggaggccgtgattgaagccctcatacaaacccagtactacacatctaaggccgccgaattaatttcagacctgtgttgcttgaatgatgcattagctcagggaagcccggccagccctgtactctccaatattgtcatgaagccatttgacgagaagctcctggagctaagtaaaaagtacaacatcgttgtgtctaggtacgcagacgatatcgtcttctcggggaaggacgagtttgataccaaccttcataaggatttgaacgaactgttcgcagaatcatgcttcacactgaattcccagaaacagtattttgcagacagaaataagggccagcgcctgaaggttcatggcctgttagtcaaagatgaaaatattgccctcactaaagggtatcgcaacaaactgagggcttataaacacatgctgaacacaggtaaagtgtccgaaaaggacgtggagcggctggttggacacgtgaaattcagtgagtttatcgagtccaagaatgtaaactga

SEQ ID NO: 14087 - RNA, 957 nt, unidentified
  source 1..957: mol_type = other RNA; note = synthetic construct
atgaacgccgcgcctctcttggttagctttctgaaagtggagacatacatcagggcactgcctattaagcagtctgaacagtacaaggatgagattataacactggtggaaaagaagttgccaccagttgtgtccccttattgcctggctgtgctgtttggctactcgcttgaattcgtgcatgccttaagtaagaaccagcacaagttctatcgacgcttcgagatccgccaggggcgtaaaaccagaaaaattgatgctcccaaagtcgccctcaaagttatccaaaaatggttcggctttcacctgagttcagctctcgaatttgagccgcatgtcttcggattcgtcaagggcctgtcatccgctaaagccgccaagctgcatgtgggggctcgatgggtgtacagcgtggacattctgaatttcttccctagtataagccagataaagatcaaagaggcgttaataaaggaagggtacaccgataatggcgcatctttgctcattggattatgctgtctggacggagcactagcccaaggctctccagcaagccccgtgctaagcaacatttttatgagggacattgacaagaaactttccgagttggctaggaaatatctcattactatgactaggtacgctgatgatatcgtgttctccggtagagacaattttccccagaaactgaaagacgaggtatcacaattgatcatcgaagccggactggtgctgaatgagaacaagcagtattttgcatctgtcgacaaggggcagcgccttaaggtacacggcctccttgtaaaagaagaggccgtccggctaacgaaagggtatagaaataagatccgggcctacaaccacatgctggccaacggtaagatctccgagaaggacatcccccgggttcttggtcacctcaagtatgcgaagtttatcgataacctgaattga

SEQ ID NO: 14088 - RNA, 951 nt, unidentified
  source 1..951: mol_type = other RNA; note = synthetic construct
atgaaggcggcgcctctgcttatcagcttccacgagttgggctcttacatcgaggccctccctgaaagccagaaacggcgttacgctgatgaaatcagcaagttggccgaagcaaaattgccccctgtggtgagtccgtattgtcttgcgattctgttcggatacagccgagaattcatccacgcaatgtccaagcaacagcataagttctatcggaccttcaccattcataaagggagaaaacgcaggacaatacaagctccaaaggtggccctgaaggttatccagaaatggattggctatcatctctgccaggccatacagaggcccgagcacgtctttgggtttatccccggctgctccgccaagatggcagcagagcaacattgtaatgctctatgggtttacagcatcgatataaaagacttctttccgtctatttcagatgagctggtagagtcagctctgcaggagctcgggtattccgagatgggttcaaagttgataactagcctgtgctgttttaacggtgtgctggctcaaggctccccagcttcgcctacgctatccaacctcatcatgattaaagtggatgacgaccttcgcaaactcagtgaagaactgaacatttctgtcacacggtatgccgacgacatcgttttttccggcaagaacgagttccccgaagggcttgggggtcagatttctaacatctttcaggatgccggattagagctgaatgaagaaaaagagtacttcgcagacagtaggaaaggacagagattaaaggtgcacggactgctggtcaactcagataagccacgactgccaaagggctacaggaataaagtgagagcctacaagcacctcctgaattctggaaaggtcagtgagggtgacctgaagcgcctcttaggccacgtaaattatgccaatagcattgagtcgtga

SEQ ID NO: 14089 - RNA, 963 nt, unidentified
  source 1..963: mol_type = other RNA; note = synthetic construct
atgatcgcaccccccttgctggtatcattctctgacatcaacagctacgtaaattcattgagtgaggagaaccaggctttacatgaaaataacattcggagcctgtttgaccagaacctgccaccaatcggatctattagtacactgagcaccatgttcggattcagcccgcgctttgtcgccatgctcctgagtgatgtgtcgaagcaatatcggaccttcgaaattcggaaaggtaaaaagaaaaggaagatccaggcacccaaggtgggcctaaaggtgatacagaaatggtttggtcatcatctctcaggggcgcttgtcctcgacgatggcgtgtatggattcgtgcctaaccgtagcgccatagacgccgcgagtaagcactgcactgcctcctgggtctactcctttgacataaaggatttctttccctccacaactcgtgaaactgttttgagcgcattggtggagctggggtacgtggaggagtccgccgaactgatttctcaactttgttgtctggacaataaattacctcagggagccccctcttcaccagccttgtctaacctcgtgatgcgaagaattgataccgaactggctcgattcgctgatgagaacaacctgacatacaccaggtatgccgatgacatcgttctgtcggggaaggaggagtgcccggaatccctctccgaggctgtccggagcgcctttaaagatacggactgggaactgaatccaaacaaagaatactacgctgacgtcagaaagggccagagacttaaagttcacgggctgcttgtgatgggggagaagcctatcctaacaaaaggttataggaataagctcagagcttacaactatatgatcgaaaatggcaaggcaaaggagaaagacttacctaggctgaagggccacattgagtatgcacgcctcgttgatcgctggaataatggctga

SEQ ID NO: 14090 - RNA, 963 nt, unidentified
  source 1..963: mol_type = other RNA; note = synthetic construct
atgaatgctcctccactcctggtgagttactctaccgtcgaatcctacctgagtgccctcagccaagattctgtctcatcctatcagaaagagataaacgacctagtcgcacgcggactgcccccagtggtgaatacgaaattgctcgggctgctgttcggcctctccaataagtttatcacttccctcctgattgacaagaagagacactatcgcaacttcaatctgcggaaaaagggtaaagtgagaacaatcaacgcacctaagatgagcctgaaagtgatccagaagtggtttgggagtcacctcgcctcaagcattgattacgcatcgtacgtatacgggtttattccaggtagaaaagcgctggacgccgccaaggtgcattgcggatccaggtgggtttatagcattgacatcgaagatttctttccttcaaccccgtctgaactagtttacgaatcccttaagagcctggggtataccgagctgggcagtaagatcatcaccgagatatgtacgcttgacggctacctaccccaaggagccccttccagtcccgctttaagcaacctggtcgccaagaatctggaccgacatttgtataaattgtcaaccgatcttggcgtaaaatatacacgatacgctgacgacatcgtgttttcaggtgcggaggatttccccaagaatctgccggaaatcatcattgagattttcgctgacacaccatggtctttatctgaacgtaagaactatttcgcagacactttacttggacacaggctgaaagtccatggcctgctcgttaaggaggacgccgtgcggcttactaaggggtaccggaacaagatacgcgcctacaaacacctgctcgagcagggaaagatcaaagattctgatttgcagaggataaaaggccacttgacatatgctaagctcattgataacgatagcgagctttga

SEQ ID NO: 14091 - RNA, 984 nt, unidentified
  source 1..984: mol_type = other RNA; note = synthetic construct
atgattgcaccacccttactggtttcttattcctcccttaatgaatatctggaggctctgggtcctgagcttagttaccagtataagaccgaaataacgcagttattcgaaaagaggctgccaatcgtagtatctttcaggtgcctgtccgtattatttggcttcagcacaaactttgtgtacaaactggcccaacaaaattggaaattttaccgcaccttcaccatccgtaaaggcaaaaaaaaacgcaccatccaggctccaaaggtcgcgttgaaggtcatccaaaagtggttcgggtaccacctgagcgaagtcctctcgttcgataaatacgttcatggttttgtgccgggacgaagtgccattggggcagcgaatgtccacacaaacgctcggtgggtgtactcagttgacatcgaaaatttctttcccacaactacgaaaaaggtcatcaaagaaagcttgatctcaatcggatattcattcgaggcagctgacctgattgccaacatatgctgctacaaggacactctggctcagggtgcccctagttcccccgtgatttctaacctagtgcttaaagaactcgataagcagctcaagaccatagccgattccaaccagattaggttcactagatatgccgacgatatcgtgtttagtggcattgataagtttccgaccgagatcaaggatcagattagcgacttgtttaaggaaacatgttggaagctgtctcctgagaaggagtatctagcggagtcacccatgcgcctgaaggtgcacggcttcctcgtgcatggggagaaagcccggcttactaaaggctatcgaaataggataagagcatacaagcatctcttgaatgccgggaagattagaaacgaggacctgggccggattgtgggacacgtgaaatacgccgagagcgttatcaaggctcagaaaccaggactctgtcctgactctgcacacagctga

SEQ ID NO: 14092 - RNA, 954 nt, unidentified
  source 1..954: mol_type = other RNA; note = synthetic construct
atgcttgcaccaccgttgttagtgtcctacacaagtcccgaggattatctcattgcgttggacccaggactccgtaggctgcatcagagtaagatcaagcggttgctcgagcagggtctgccccctgtggtgagctccagatgcctgggggttctgttcggttactccaccaagttcatcaatgccatggcccaacagaattggaagtactatcggtcattcaccattcgcaaaggcaagaagaagcgcaaaatccaggcaccaaaggtagcgctgaaggtgatccaaaaatggtttgggcatcatctgagtgaaagtctctcgttcgacgaccacgtatttggcttcgtccctggcaagtctgcaccctttgccgctaaacagcacactaacgctcgatgggtctatagcgtcgatatttctaatttcttccctagcacccccaaggacgtgatttcaacaactcttgtggacattgggtactcagaaaaggctgcaaagctgatgagcggccttctatgtcaccgcgactatcttgcccagggctcccctgcctccccaatactgagcaatctggtttttagagagctcgataaacagctcaaagagatcgccggaaacaataggataaggttcacccgttacgccgatgacatagtgttttctggggtcgaccaattccccgaaaacattaaagaacaggttaacaacctgtttgctgattcttgctgggtgctgtctaaggagaaggagtatttttcagagattcctaaacgactgaaagtgcacggattattagtccatcgcgatagaccgcggcttacgaagggttacagaaataggatcagggcctacaaatatctattggagacaggccaaatcgaaaaacgggatctgagcagaatcatgggacacctcaactacgctaagtccatcgacactcaggaaaaatga

SEQ ID NO: 14093 - RNA, 954 nt, unidentified
  source 1..954: mol_type = other RNA; note = synthetic construct
atgaaggcacctcccctgttagtgtcctactcatcgatcgacgattatctgtccgcaatttcaccggaagacagagagcaatatgaaaaacagattaggtcgttggtctgtaaggggctcccacctgttgtgtctagccagtgcttagccaatctgtttggatataccaataccttcgtgcatagcatggcttcaaagaactggaaatattaccgtggattttctatcaggaaggggaagaagaagagatacatccaggctcctaaggtcgccctgaaggtgatccagaaatggctcggctttcatcttgccaaatccatcaactacaacgatttcgtatatggttttgtggaaggcaaatccgccatagacgcagcagcctgtcacactaatgcaacttgggtgtatagtgtagacataaaagacttcttcccctcaaccagcaaagagacattgatcagtaaccttgaatccctcggttactccaggaaggcttcagctctgattgcgagcttatgctgttacgaagattatctggctcagggaagtccaagcagtcccgtgctatctaatctggttatgcgggatattgacttggagttgtacaaaatcagcatgatccacggcgtcaggctgacacggtatgccgacgatattgtgttctctggacaaagcgagttcccagaatccctgaagcgagaggtcaagagcctctttgtggatacatgctggtccctgtctgagcagaaggagtacttcgcgcaaatacctaagcgcctaaaggtgcacggccttctcgttcatcagaatagtccccgcctcaccaaagggtaccgcaacaaaattcgagcttttagacaccttctggaagcccacaaggtccatgagaaagacattaaaagactgacgggccacatcaaatacgccgagtctgttgatcggcataagaactga

SEQ ID NO: 14094 - RNA, 960 nt, unidentified
  source 1..960: mol_type = other RNA; note = synthetic construct
atgattgctgcacccctattggttagttacaattctctggaggactacctctcctgtctgagtagcgaaatgcgcgaggaacacgaacagcagataagatggttggtggaccaaaagctgcctcctgtcgtctcaagccgttgcctcagcgtgctcttcgggtacagtgcaaagtttgtcaatgcgatggccctgaacaactacaactattaccgcgagttcactataagaaaaggcaacaaacgacggaaaatccaggcccccagggtagccattaaaggcattcaaaagtggttcggacaccacttgagcgaggttctgccagtggaggattatgtctacgggtttatcccaggaaggagcgctgttgatgcagccgcacagcattgcggcgcttcttgggtgtattcagtcgatatcgagaacttctttccgagcacaacagacgatgtagtgattaaagcattaatggagatcggatacagtgagaaaggcgctagacttataacccggctctgctgttatggcgatcgcctgggacaaggtgccccatcctctcccgttctctccaacctggtgatgaaacctatcgacattcagcttaagaatatcgccgagaatctaggggtgaagctcactcgctatgctgatgacatcgtattttcaggccagggaaaatcccctgtcgaattaagggacagggtcctggatgtgtttaaagacacctgttgggatctggccgaaaacaaggaatatttctcgaattcagacttagggcagcgacttaaggtgcatggcttgctggtgaatggtgagaagccacggctgacgaagggttaccggaatagggtgcgggcctatagacacctgctggagaacaatcgtgttaagcccgaagacaagcgaagacttattgggcatatcaagttcgcggaatccgtggaatcttggaaggagtga

SEQ ID NO: 14095 - RNA, 960 nt, unidentified
  source 1..960: mol_type = other RNA; note = synthetic construct
atgaagccaccgccctttttcgtgtctttcaggactgctgccgattatcgggcggctctgggcgatggtgttgcggaattgtactggcccgatattggccatcttggcgagcgtagactgccccccgtagtgtccgtacgagccttggcatgcctttttggcgtgtcttccaaatttgtgggagccctcagaagaaatccagagcggtattatcggtctttcgttatacgcacagggaggaagaagcgccagatccacagcccgaaggttgggctcaaagtctttcagaaatggttcgggacccacctcgcagcagcactcgagttcgatccttgggtattcggcttcgttcctgggaggagtgcgccaatggccgctcgtgtgcacgctagagctcgatggatttacagcgtcgatctagccgactttttcccatcagtgtctcgcactagggtggtgggagctctgcaaggactgggctaccctggccatggtgccgagttagccgccagtctctgttgctacggcgaaggccttgcacaaggctcccctgcaagccctgtgctgtccaatctggtctttagggaacaggaccagcagctgcacgagctggcgagggaatttggggcacggttgacgcggtatgccgacgacattgtcttcagcggtcaggcagccgtacctgctggacttcccgaccgggttaaagctgtggtgaccgccggagggtgggacttaaacgacgccaaggaagagctggccgaatcacccatccgtctgaaggtgcacggactcgtggtccatggtgaccgcccacgcttgacaaaggggtaccggaacagaatccgagctctaaggcacctgagcgccgtcggtaaagtgagatcggaagatgctgcccgcgtcgcaggacatttacgatacgccgacagtatcgatagactgtcagaggaggagtga

SEQ ID NO: 14096 - RNA, 969 nt, unidentified
  source 1..969: mol_type = other RNA; note = synthetic construct
atgaacactccacccttgctggtcgtgttcccgggcctggaatcccttggcgctgccttggctagggatacgcaccgcatctactggagcgacgtagaaagactggttgagaggggcttacctcccgcggtgagtgtgagggtggtggcatgcctgttcggattttctgcgcgtctcgtcggtgcaatccagcggagcccagagcggtattacaggatattcaagattccaaaagggaaatcatcgaggcagatagaagcccctagggtcgctctcaaggtaatccagaagtggttcggatcccatttggctgccgcctgccctcttgacgactgcgtgtatggatttgtgccgggcagatcagcacccttagccgctaaacagcactgtggcgccagttgggtttacagcctcgatatccgggatttttttccctcagtaagctcaggaatggtgagcgaagcactgcgcctgaaagggtaccctgatcacgcagcctctctcatggccaagctatgttgttatgagggacggctggcacaggggagtccagcttctcctgctctgagtaacctggtttttgccccagtcgaccaactgcttgccgaaattgcacgggcgaatgcttgcacatacactagatacgctgacgatatcaccttctctggccgaacagaggtccccgcacgcttacaggaggaggtgagaaaggccctgcaagagggggggtggcagattgcgggtcataaagaacacttggcccgtgctcctcgacggctcaaagtccacggcctgctggttaacggaaggttcccccgccttaccaaggggtatagaaatagactccgcgcactggagcatcttctcggacagggccgactggacgaagccaaggagatggaagtgagaggccatctagcctatgcccgctccgtggagagcttgcaaaagtcctccgatggtggttga

SEQ ID NO: 14097 - RNA, 972 nt, unidentified
  source 1..972: mol_type = other RNA; note = synthetic construct
atgagaacccctcctttccttctgtcattctcctccctcgaggaatacctgcgagcactgtccgattccgacagagcggaaaaggggtccgaaatcaacaacctagtggctcagcagctcccccccgtcgtttctaaaaagtgcttagccactcttttcggcttttcaaactctttcattgacacacttcacagacggaccgagcgatattatcggatatttgaaattcccaaaggcaagaagaagcgcataatccaagcccctcgtgtggcgctcaaagtgatccagaagtggtttgcccattatttggctaattcactgaacctgcacgaggctgtgtttggatttgtgaagggaaggagcgctgtgcagggagccgcactacactgtggcgcacattggatttactctgtcgatatcgaagacttcttccctactacaagcatcgacaaggtgattagttcgctgacgaacctcggttatggataccccggggctgccctcattgccaagctttgctgctacgagggtaatctcgcccaaggtagcccagcctccccagtcctgagcaatctcgtattccgcgagatcgacgaagaactgtttaccttgagtaaacagaatgggatctgttacaccagatacgccgatgatattgtattctctggcatcaattcttttcccgatcacattagggaggaggttatcagcatcatacaggccagggggtggaagctgagcatcaagaagattcatttggcaaaaaggccgtacagactgaaagtttacggcttactgatacatggggagcgtccgcggctgacaaagggctatcgcaaccggatcagggcgttcaaacatttattcgcagacggcaaaatcccagaggacgagataagtaaaattcgcggacacctgtcatatgctcacagtattgaagagtttgagatgatgccaaaagatgacttgtga

SEQ ID NO: 14098 - RNA, 960 nt, unidentified
  source 1..960: mol_type = other RNA; note = synthetic construct
atgaacgcaccgcccttactggtatccttctcgagcaccatggagtaccgggaagcgctgagccacgaattgcgcgggctctactgggagactatcgagaagctcataagcaagaaattgccccctgtcgtgtcgattagatgcctgagtatcctgtttgggtacagcccaagattcctgggggctatgtatcaatttactgaacgctactatcgtacgttcaccattaaagctggcaaaaaaaagcgaaccataaacgcccccaaagttgcgctgaaggttattcagaaatggctgggttaccatctgggcgaatcattgtcattttgtgaccacgtgtacggatttatcaagggtaaatcagccatccagggagcttacgtgcactgtggtgccagctggatctacagcgtcgatattgagaatttcttccagactacaaacattgagaaagtgaagtccgccttaaatggcatcggcttccaggaacgaggatcagaagtgattagtaagctttgctgctacagtgggaacctggctcaaggatctccagcctcccctatcttgtccaatctcgtatttacaaacacagacaatgatctagcaagactggccaacaagaatgggctattatattctcggtacgctgacgatatagtgttctccggaaaagaagacgtccctgccgacctgtctaacgatgttaaatctattatcaccagatctggctggaaaataagcgagaaaaaggagtatctcgcaaagaggccacacaggctgaaggtctacggcctcctcgtgaacggcgattatcccaggctgacaaagggatatcggaatcggatcagggcttttaagcatcttgtggagaatgagaagattgcagatgagaataagaagcgccttcttggtcatctcgcctatgcaaagtccatcgacaacttcagtaacaaatattga

SEQ ID NO: 14099 - RNA, 969 nt, unidentified
  source 1..969: mol_type = other RNA; note = synthetic construct
atgcagagcccaccccttctggtgtcctatccagagctcgaggattttatcaaggctcttccaaatgactatgcggccgatacaaagcaggtgctgcgccatctgcactctctgtctttaccttctgtgacctccataacatccctggccgtcttgtttggtttcagtcctaggatcctagcctccatgaccaatcaaccggagaagttctacagagtgttccggatccataagggtaaaggaaagtacagaacaattcaggctcccaaggtggccctcaaagtcattcagaaatggctgagtcatcacattagcgaagccatcacttatcccaaatacgtgcatggcttcgtgcccgggcgaagccacatcactgctgcacaggcacacgttggagcgaattgggtgtattcaatcgacatcgagaattttttccctactacctccgagagcaaggtcgaggcagcactgaggggcattgggtacagcgaatccggctctaagctcattagcaagctttgctgttatacgaagaacttgtcgcagggcagccctgcctctccagtactcagcaacctggttttcaaagacttggactctcggattgctgaactctcttcacagatcggggtgaactacaccagatacgccgacgatttagtctttagtggacaaggcgaatttccagaggctttactgcctgtcaaggcatggatatccgaggccggttggagtgtttcaaaagataaggaacacttcgctcaattgcccaagcagaggctgaaggttcacgggctccttgtacacgaatcaagtccgattctcaccaaaggataccgcaaaaaaatccgaacgtataagttcctacacgagaacaaccggatacgtgaagatgacaaaaaccgcatcctgggccatctgtcatacgccaaactggtggattcgttttccaatcagacagaggaatga

SEQ ID NO: 14100 - RNA, 978 nt, unidentified
  source 1..978: mol_type = other RNA; note = synthetic construct
atgaaaacacccttgccactgttttttacctttgccgacgcagaacagttgcttaaggccctgagcaagcctttgagagacaggtattccgcggaattacttcgactccagcaactaggcctgcctcccctggtgtcttggtctatcctgagcgtcgccatcggcgtatcacctcagttcatcacctcaattctgaagaacaagtctaagtactatcgggtcttcccgatcagtaaagggaagggcaaaaaaaaacgcattatagaggccccaaaggtgtccctaaagattatccagtcctggtttgcctaccacatatcgctgaatgggaacattaccttgagtaagagcgcattcgcatttattcccggtaaaaacggaatatacgaggccgccagcgttcattgcggtgctaagtggatcatgtctatcgatctgagagactttttccacacgatcaccagtgaggctgttgtcttagctctgactgagattggatatagggaggatcaagctagcaagctgtcagatctgctgacactgaatcagagattgccacagggcgccccttccagcccagtgatcagcaaccttgtgttctcgaaaacagacttcaagattaatgagcttatcgcagatttaaacgtgaaatacacacgctatgcagatgacctcaccttttcctctgaagacgaatcattcgatatcaatagtctcaaggaacggatcgtacagatactggtttccgataattggattgtcgctgacgagaagctgaagatagctaaggcgccgaacaggctcaaggtgcatgggttcctagtgcacgagattaaaccccgtctcactaaagggtatcgcaacaaaatccgagcctacaaacatctccttaatactggaaaagtcgtgctggaggacctcgataagattaaaggccacattaactactctgactacatcgaccggctcaatgaatga

SEQ ID NO: 14101 - RNA, 978 nt, unidentified
  source 1..978: mol_type = other RNA; note = synthetic construct
atgaaaacacctcttcccctgttctttactttcactgatgccgaacagctgctgaaggcattatccccaagcctcagagatcgctactccgctgagctcatccggatgcaacaactgggcctacctcccctggttagttggtctgtgctgtctgtggccatcggcgtatccccacagttcattacatcgctgatcaagaacaagatcaagtactacagggtgttcaccattcccaaaggaaagggtaaaaaacgccgggttattgaggctccaagggtgtctctgaaaattattcaggcctgggtagcgtatcatctgagcttgaatgagaacatcagcctcagtgagtctgcatttgccttcatcccgggcaggaatggtatatacgaggccgcaagcaaacactgcggcgccaagtgggtcttgtccatcgacttaagagacttttttcacacaattacgagcgtgttagtcagcgccgcgcttgtcaaaatcgggtacaaagctgatcaggccaacaagctttcagatcttctcactctgaaccagcgtctgcctcagggagctccctccagtccggtaatctccaatctcgtgtttaagtcgaccgatttgaaaatcaacgaacttatagtcggcatgaatgtcaagtacaccagatacgctgacgatctcacctttagctcagaggacgaaggagtggacattgaactactcaaggagaacgtgctacgagtcctgaattcagatggatgggttgtggcagaagaaaagctgaagataagtaagtcaccaaatcgcttgaaagttcatggcttcctggtgcacgagataaagcctaggctgaccaaggggtatcggaacaagatccgagcatataagcatttgctgcagacagggaaaattattgagggggacctggacaagataaaaggacacgtgaactattctgcctatatcgacaaactcaatgaatga

SEQ ID NO: 14102 - RNA, 978 nt, unidentified
  source 1..978: mol_type = other RNA; note = synthetic construct
atgaagactcctttaccactgtttttcacttttacagatgcggagcaattcctcaaagctctctcaacgccactccgtgatcggtattccgctgagcttattcgcctgcagggcttaagactgccccccctggtcagttggagcatcttgtcagtagccattggcgtctccccccagttcatcacctctcttattaagaacaagtcgaagtactaccgtgtcttctcgatcagtaagggtagagggaaaaagaaacgaatcatcgaagcccctaaggtgtccattaaaattatccaatcatgggtggcgcaccacctgtctatcaaccacagcttggggatctccgaaaatgcctatgcctttataccgggaaagaatggcatatacgaggctgctagcaagcattgcggggcaaaatggatcctgagtatcgacctacgcgatttttttcacaccattacgtctgatatcgtgataagcacactagtggaaattggctatcgcgccgaccaggccgccaaactttcagaactgttgaccctgaatcagagactcccacagggtgccccaagcagtcctgtgatatctaacctggtgttccgctccacagacctcaaaatcaatgagcttatcagcaacactgggattaaatacaccaggtacgcagatgatttaaccttcagcggagatgacgaaacattcgacatcgaggaattgaaagacaacgtcgttgagctgcttctgtctgataattgggttgttgctgaggaaaagctccggattgcaaggattcctaaccggctgaaggtgcatggatttttggtccacgagaataaacccagactgaccaaaggttacaggaacaagatacgagcatataagcatctgctgaggactggcaaaattgtagagaaggacttcgacaagatcaagggacatgtgaattattccgaatacattgaccggctcaacgagtga

SEQ ID NO: 14103 - RNA, 999 nt, unidentified
  source 1..999: mol_type = other RNA; note = synthetic construct
atgaaaacaccactgcccttgttatttagttacgaggacgaggctcagttcctccgaagcctcagctcaggtttaagaaaccggcactcagaggaagtgcgccgtctggtcgccataggactccctccagttgtgagctggagtgtgctatccgtggcaattggcgttagccctcatttcctgaacagcatcatcaagaacaaatgtaagtactatcgctcttttacgattagtaaaggaaaagggaagaagaaaaggctgatcgaggccccaaggatctcactgaagctgatacaggcttggttggcctaccacctgtctcgcaatagcgccgactacatctccgaaaattcgtacgcgttcatacccggggtgaatggtatctatgaggccgcaaaacggcattgcggctcccagtgggtgctgtcgattgacctcaaggactttttccactatgtaaactctaacaagatcatgcccgcactgctggatcttggatacaggacagaacaagcagctaagatcatcgatattgtcactctgcaggataggctaccgcagggggccccttctagtccctacatttctaatatcgcttttaaacccaccgatgagttaatcgaaagaattattaccggaagaggtgttagctataccagatacgcggacgatttgaccttctccgggtgcgatgccgagttcaacatcgacggcttcaagggcgaaattattaacgctttgaagtcccacggttggatagtagcccttgataaagtcaaaatctctaagaagccaaaccgacttaaggtccacgggtttctggtgcataatcagaagcctgtcctcacaaaaggctaccggaataagctccggacttaccgtcacctgatgcaagcaggaactattaagcctgacgatctcgacaaaataaaaggccatctgaattatggctattatatcgaccgccttaattcacaggaagtggagttttcctgttga

SEQ ID NO: 14104 - RNA, 990 nt, unidentified
  source 1..990: mol_type = other RNA; note = synthetic construct
atgaaaaccccactgcccctgctttttagctttgagaacgaaacccagtttctctcctccctgtctttagggctgcggaatcgacacgcagaagagattaggcgtctgcttgctttggagctcccgcctctggtgagttggtcggtgctgtccgttgccatcggagtaagcccccatttcctgaacagcataatcaataacaaggtcaagtactatcgaacatttactgtgtctaaggggcgggggaagaaaaggcgcctgatagaagcaccccgggtgtccctcaagctgatccaggcctggatcgcacacagtctgtcccacatgtctagacaatatattagcgagcactcctacgcctttattcctggtgtgaatggcatatacttggctgcaaaaaagcactgttcaagtcaatgggttctatcaatcgacctcaaggacttcttccacagcataacagccgagaaaatcatcccagcccttattgagatgggctacagggctgagcaggcttctaaaattatcgatttgatcacgctgaatgagcgtttaccccagggggcgccatcaagcccttatttctccaatgtgtctttccggccaacagatgacttaatcgtgaggatgattgacggacagagtatcaaatacactaggtatgcagatgatctaaccttcagtggcgtggacctggatttcgacgtcgaaaaattccgcgatgacatcattgccgttcttcacgagcataactgggaagttgccctcgagaaagtcagaattagcaagcagccgaacagactgaaggtccatggctttctcgtacataatgataagcccgtgctgaccaaaggttatcgcaacaagattagagcttatcgctaccttatgttgtcaggcgcgattaagcctgatgacatatgcaaagtcaagggacatttgaactactcagactacatcgacagactcaatgcctctgaagaagtgtga

SEQ ID NO: 14105 - RNA, 978 nt, unidentified
  source 1..978: mol_type = other RNA; note = synthetic construct
atgaaaacacctctgcccctcttctttagctatcccgatgccgaacagctgttaaaagctcttagccaatcgctccgggtgaaatatagctccgagttggcccgcctggaacagctcaagctgccaccccttgtgtcctggagtgtgttgagtgtggctattggggtcagccctcagtttatcaccagcctgattaagaacaagtctaaatactaccgggtcttctctatctccaagggcaaaggaaagaaaaagaggacaatcgaggctcctaaagtgggtctgaaaattattcaagcatggattgcgcatcacctatccattaacaccttcctagatatctctgattccgcgtatgcattcataccaggcaagaacggtatataccaggcagctaagaagcactgtaactcaaaatgggttctgagcattgaccttaaggacttcttccataccatcaccctggacaaggtaattctggcactcatcgatattgggtatcacgccgagcaagcctcaaaactggccgagattttgactctgaaccagaggttaccgcagggcgctccatcctcacctgtgatcagtaatctcgtctttaaaagcacggacgcctgcatcaacgagttcatagtcgaggataacatctcctatacaaggtacgccgacgacttgatctttagcggggtaaatgaggatttcgatatcgattcactgaaggacaatatcatagttctgttacagtctaagggctggatcatcgccgaagaaaaactgcacatcgcgaaagttcccaatcgcctcaaggtgcacgggtttttggtccatggcaacaagccaagactcactaaaggatacagaaataagattcgggcttacaatcaccttcttcatgccggacgaataagtgaaaaggacatcgaccgtataaagggacatgtgtcttactctgcatttattgatagtctgaatgactga

SEQ ID NO: 14106 - RNA, 984 nt, unidentified
  source 1..984: mol_type = other RNA; note = synthetic construct
atgaagactccccttcctttgctgtttagctataatgatgcgcagcagtttctgggagctctaagccctgaggtccgcgatgtctacagccctgagattaaccgactctttgacaggggcttgccgcccgttgtgtcctggagtgtgctcagtgtcgctatcggggtttcaccgcacttcatcaactcaatcattaagaacaaggataagtactaccgtatcttcccaatcgcaaaaggcaaggggaagaaggtgcggattatagaatccccaagagtgggactgaagatcattcagtcgtggctggcccaccatcttgcaacaaacgataatattcccgtctcagactcagcatatgccttcatacctggaaaaaacggtatctacgaagccgccttcaggcactgcaatgccaaatgggtgctctctatagatttaagggacttctttcactctattgatttcgaccgcgtgatcaatggcctgagaaataccggctacacttttgaacaatctggaaagatcgccgcgatagtcacatacaagaatagactgccacaaggtgcacctagctcccccgtacttagcaatattgtatttaaagacacggatgacaagatcaacgacattatcgccgacaaaaagattatctatactcggtatgctgacgatttgacattctcttccgatgacctctccatcgatgtggagaacctgaaacagaatattataaacctgctagagaacgagaattggacaattgctaccgagaaacttaaaatcagtaagattcccaatcgactgaaggttcacggcttcctcgtgcatgatgttaagccacgcttgaccaaagggtaccggaataaactgaggacctatgaacatctgctcagaaatgggaaaatcatagaaagcgacttaaaccgtattcggggtcacgtgaactatggcaaacatatcgacaagctgaacgacgagaactga

SEQ ID NO: 14107 - RNA, 984 nt, unidentified
  source 1..984: mol_type = other RNA; note = synthetic construct
atgaaaactccactccccctgcacttttcatacgacagtttagaccagttcctggcaatcctttccccaggccttaggcagcgccatgccgaagagctgagacgactggatgatttgaaacttcctccggtagtgagttggtcggtcctcagcacagccattggtatctctccgcacttcatcaactctttgatcaggaataagaacaaatactacagggtcttcacaatcgcaaaaggaaaggggaagggaaaaagggtcattgaggccccaaaagtgagcataaaattgatccaagcttggctggcgttccatctctccaataacgacaacctgggcctgtgcgatgcggtgcatgggtttatccccggacaacacggaatctatgaagcagcgaagaagcactgtgggtgcgactgggtgctgtccattgatctgaaagacttcttccactcaatctcacaccgccgggtggtaaacgcttttgagaatctgggctatacggtggcacaggctgagaagatcgcagacattaccacctataatgcccacctccctcagggagctccaagcagtcccgttattagcaatctggtgtttaacgacaccgataatgctataattcgcttcctagatgggaagggtatctgttatactagatacgccgatgatttaaccttttccggttcagatatttcttatgacgtcgagaagttgaagactgagatgctgcagcttatctccaacgacgggtggatcgttgccaatgaaaaaacacacattgccatagctcccaatagattaaaggttcatggctttctcgtgcatgccgtgacacctcggctgaccaagggatatagaaataagatacgtgcctacacccatctcctgaactctggcaaagttgaccctgaagatctcgacgtcattcggggccacgtgaactacggccgatacattagcaagctaaacaatggtaactga

SEQ ID NO: 14108 - RNA, 966 nt, unidentified
  source 1..966: mol_type = other RNA; note = synthetic construct
atgcgtaccccgcctcccccactcctcgtaagctttaagtccactcaaaatcttttggatgcactgccaagcgccattagtgagaagtacaagaccgaaattaatgagctactggataagatgctgccacccgtcgtcagcgtcgccgttgtcagcatcatttttggggtgagctcaaacttcattgccagtatactcaggaatcccataaaacagtatcgggtgtttacgatcaagaaaggcaagaagaagcggcgaatcgagtcccccaaaataggtttaaaattactgcaatcctggatcggagcaaatttgtcaaacaaaaagcttctgagcgattctgtgtacggcttcgttcccaaaagaaatggcgtgtttgaagctgctcagaaacattgtctggctaaatgggtttattctatcgatcttcgggactttttccctaacatctcaagcagaaggattaagaatgagctggaaaagttggggtattcgaagcacgccatcgagctgatctcaacaatctgcacctacgaagaccgacttccgcaggggagtccagcatctccagtgctgtccaatctcgtgttccgggagactgacaaaaacttagaggagcttgcgaagatgctggatattagatacacacgctatgctgacgatctagttttcagtggcctcggagtgattcctgagaacttgcagaacaagatcaagaaaattctgatcgacgacgattgggtgctggccgaggaaaaagaacacttgtctaagcttcctaaccgcctcaaagtccatggcctgctggtgcacggggacaaacctcgcctcacaaagggatacagaaataggataagggcgtataaacatctactcgaactggagaagattaaggaagtagacctgtactcttgcaagggtcacgtgtcctacgccaactccctggacaagttcaccgataaatga

SEQ ID NO: 14109 - RNA, 963 nt, unidentified
  source 1..963: mol_type = other RNA; note = synthetic construct
atgaaagccttatcaccacccctattcgttaatttttccagtttagacgaagcgtttcaagctttttcttatcccgaaaacattcaggactggagagcactgactcagaggaacctccctcctgtgatctcaactcaattcctcagcctcctgttcggcgtcagtcccaattttattagttcgataacgcgcaaacccaacaaaaactaccggacatttattatcaagaagggcaagaaggaacgtgtgattaattcaccaaagatcggtcttaagctgttccagacatggattggacatcacctctcccgggcagtactgctggaggaaaatgtatgcggcttcattcctggcaagaatggaatcttggaggccgcttctcagcattccgcagccgggtggttgtattccatcgacttgcgggatttcttcagtaagattaattccgagcgcgtgaaaagcgctctgctggacctgggttaccccgaggattccgccaaacttataacctctctgtgtaccctgaacggatgcctaccgcaaggaagcccagcgagcccagtccttagcaatttagtgttcaagagcacagaccaaatcttcatagatctggcatcaaagctgaacattagatacaccagatacgcagatgatctcgtcttttctgggaacaacaaccagcccgagaacctccctcagatcatcaaggaaatcctgaacaatgagaattgggagatcgcccctgaaaaagaagagaatttgaaagccccgtatcgacttaaagttcatggtctggtggtgaacgggctgactccacgactcacaaaagggtacaggaataggatccgcgcctacaaacacttgaagaataccaacaagatcaaggacaacaaagagaaaatacagggccaccttgcttatgccgatcaggttgacaagttttttgctcagaagatttcttga

SEQ ID NO: 14110 - RNA, 963 nt, unidentified
  source 1..963: mol_type = other RNA; note = synthetic construct
atgaagacgagcccacccccccttttggtgagctttaagtccgctaagaacctcatcgatgctctgcctccttctgtgagcgagaagtacgaggatgagataaagtatttgaccgaaaagaacctaccccctgtggtttctgtggccgtggtcagtataatcttcggagtgagtagcaatttcgtagcctctattctcaggagaaaggagtctcagtaccgcaactttactatcaagaaaggaacaaagcggcgaaagattgaggcgccaaaagttggcctgaagatcttccagtcgtggatcggtcacaatcttagctccgcactgatattcccgaaatgtgtgttcggttttatcccagacatgaatggggtctttgaggccgctgatgtgcattgtgaaagtaaatgggtttactctcttgacctgagggacttctttacctcaatatcacgcgagaaagttaaatcagaactcattaacctgggctacagtgcccatagtgccgaattgatcactattttatgcacttatcaggggaggcttccccaaggttcccccgcatccccagtcctgtctaatatcgtcttccagaagaccgactcccggctcctgaaaaaatccgaagagctaggaattaagtacacccgctatgctgatgatctggtcttctcaggcatcaaccctatgccggcagcattacctgaactgattaaagaagtactgctggacgagggctggacaattgcggaggaaaaagagcacatcagctgcttaccaaatagactgaaagtgcatggccttctcgtacacggggagaagccccggctgacaaagggataccgaaatcgtattagagcctataaacacctgctcaacagcggcaaggtgaaggacgctgacttggatatggtgaatgggcacatctcctatgccgagaatctcgaaaggtttaacaactga

SEQ ID NO: 14111 - RNA, 1080 nt, unidentified
  source 1..1080: mol_type = other RNA; note = synthetic construct
atgcaccgccgcgctccagctaagaggcagaggctcctccggatccgatgcctgagtgcaggtggtaataatgagagccaagattcctttgcctgcatgggcacccccccaccaccgattttagtctcttttaggtcttttgacgatctgctcgaggctctgcctgtggacggacgtgaggaatataggcaggaactgcagcaactgtacgataaggtccttccccctgttatatcaattagtatcctgtccgttctgtttggactttctgcctccttcatcgcatccatgctgagacgcccccacaaacattacagacacttcgtcataaagaaaggccgaaagagacgggagatctatgcccccaaggttggattgaaactcttccagagatggattgggcatcacctagctgaagctctcaattaccctgactgtgtgctcggctttgtgccccacaaatcaggcgtgttctccgctgctaacactcactgttccgcccggtgggtgtactcactggatttgaaggacttctttagccaggtcaccggggaacggctaagcgcacctctcatcggcttggggtacagtcagaagagcacctcaattattcttaaaatctgcctgttcaacggattcctgccgcaaggatcgcccgcaagcccagtacttagtaacttagcttttgaacctacagaccgcgagctgagcaaccttgcaaagcagcatggtgtgcgctacactcgttatgccgacgaccttgttttcagcggcgaagccctgccgcctgagggatttgaggcccaggtgaaggagatattggcggtgaacaattgggagatcgccaaggagaaagagcattttgccgcactcccagcaagactgaaagtgcacggtttactggtacatggcgcccgacctcgtctgacaaaggggtacaggaacaaaattcgggcgtatcggcatctattgaatacgggcagggtgaaaccaggggacctcgcgagagtaaaggggcacgtctcttattctgattgtctggatcacttcgtggaaaatggcgccttcgaacccaagtga

SEQ ID NO: 14112 - RNA, 903 nt, unidentified
  source 1..903: mol_type = other RNA; note = synthetic construct
atgaatcatggtgataccgtgaaccagataaatgagatcgaaagattactggccatcggcctgccgccggtgattagcctctcctccttagccacaatgctgggggttagtgtcaacataatccagtacattgtacgccacccaagcaaactgtatgacgcatttgagctcaaaaaagggcgtaaagtccggcagatttcagctccacgagtcgccctcaaggtaatccagtcctggtttagtgttcatcttgcgaaggtcattccctatccaaatagcgtggtgggcttcagacccggtgtgcctggcgttttcgaaggcgcttcgagacattgccaggcatcttgggtcctgaacctggacatcaaggacttctttgacagcatcaatagggaacggctgaagaggcctctgctggagcttgggtacactgagaagtctgccgatttggtgctggatctttgcacattaagtgatcagttgccccaaggagccccttcctctccacccctcagtaacctcgcatttatgcgcaccgacaaacaactcgaagaggtttgttcacggttcaaggtgaaatatacccgctacgccgacgacctcatcttctctggggaaggtgagtttcctgagggcttcgacacagagataaaagatgtcctggcaggaaacgattgggaaatggctgagtcaaaggaacagctagtgttcgcacccaagaggttgaaggtgctgggacttattgtcaacgatgccgtgcctaaactgactaaagggtacaggaataaggtgcgagcttacaagcacgtgctgtccacgaagggaagcgaggctgataatttcgccgtactacaaggccacattgcgtatcacgactcattggttaagtttaacagcgactga

SEQ ID NO: 14113 - RNA, 1182 nt, unidentified
  source 1..1182: mol_type = other RNA; note = synthetic construct
atgttgaatgcttgtctgtgctggcagggaaggaagaatggcaagttctcttttggggggagcgcctctgcccgagcttgcattacccccattagtgaggactacgtgcagaaagaagcttgcagaaaggccggagcgccctcaaatcacccccccttcggtcggctacatcagaggcgactgttcagtctggcctttgccgttaaagccctaccacctcctctttttgtttcctttgcaagcctgtcagaagccctcgaagctatgcccgtggtgtacagagacggcatccgcgccgtgatgcaacctttggtggaccagggtctgcctccagtccttagcagtggggtggttgccaccttattcggtgtgtccactacttttattagagctatcgccaactctcctgcacggtattacagagaattcacaattcgcaaaggcaagaaactccgcaaaatctcggctccgaagatcgctctgaagctgatccaaagctggatcggaacccacctgtcacactccgtcgtcctctcaaactgtgtgctcggatttgtgccaggccacaacggtgtcatagaggccgcagcgcgccattgttctgcgaagtgggtatactcactggatctgcgggacttcttccccagcatcgactccaatagggtgatccagagcctgttgaaattgggctaccccgaatcggcatccattctgataacacagttgtgcaccctgggagggagccttccacaaggctcccctgccagtccggtcttttctaaccttgtgttcatccagacggatgtcgagcttaatgcgatggcagaggagttcggcgtaagatacactcggtatgctgacgatctggtgtttagcggagagggggagcttcctgctgatctgcagacaagggtcagggattgtctcgataagcatgcatggcacatagccccagaaaaagagaaggtggttaaactcccccaccgtttaaaggttcacgggctactcgttcacggctccgagccacgcctcaccaaagggtatcgtaaccggattagggcatatcgacatttagtactggctggcaaggtaacagccgaggaccaagccaagatagcaggacatattagctatgctcagcaggtggaatctgcctccggctctcagatggcaccaagttga

SEQ ID NO: 14114 - RNA, 921 nt, unidentified
  source 1..921: mol_type = other RNA; note = synthetic construct
atggacgaggctctggaagctatgccggaacggtttagggaaggtatccaacaggtcatgcagccccttgtagaacgggggctccctcctgccttatcagtgggtgtggtggccaccctgttcggcttaagtatcccttttattagggccatcagcttgaatcccgggaagtattacagggaattcaccattcgaaagggcaaaaaggaccggcgaatctctgctcccaaggtggcactcaaactgctgcagtcttggataggaacacacctgtcccactccgtcaagctagatgactgcgtctttggttttgtgccaggaaggaacggcgtgattgaggctgccagaagacatagcgaggcccgctgggtgtactcactagacttgagagacttctttccaagcgttaaaatcgatcgcgtcgagtctgcgcttgttgagctgggctattccataaactcagcctcgttcattgccacgctctgtacactgaatcaggcacttccacaggggagccctgccagtccagtgctcagcaacctggtgttcgccaataccgataaggcactggtccagatagctactgaagagggggtacgctacacacggtacgctgatgacctggtattttctggacagggaatcgtcccccccctgttgcaggatagagtttgtgcctgccttgtagaccacggctgggagatcgcgccagaaaaggaatccctcgtcgagctgccgaaacgcttgaaggttcatgggcttctcgtgcatggcgtgacccccagattgactaagggatatcgtaaccgtattcgggcttacaggcacctgttcgcggcagagaagattcagcctgcagacctggataaagtgaaaggccacctcagttatgcattacaagttgagaaagtgcctcaatga

SEQ ID NO: 14115 - RNA, 963 nt, unidentified
  source 1..963: mol_type = other RNA; note = synthetic construct
atgaaagcccctcctcttctggtttcattttccgccgtggaggacttcgtagcgagcctgcctgacgcggttagggaggcacacgaaccggaaatcttaaaactccacagcgcaggtcttcccgctgtcatttcagttcgtgctatctctacccttttcaatatttccgctgagttcgtcaatgcgataagccgaactcctcagagacactatcgtaagtttcagatccggaagggcaagaagacccgggatattctggctccccgcgtggccttgaaggtgatccagagatggattgccacgcacctggcagccagtattcgactgccatcctgcgtcttcggatttgtccccggcaaatcagtaattgatgctgccagtgttcattgtgacgccacatgggtatattctctggatctgcgcgatttctttccaagcataacagcacggcaggtctacgacgcaatccgctccctcggatacagtgaagatgccgcctccctggttatgcaactctgcacactgaacgggtctttgccacaagggtcccccgcctcaccagtgttgtcgaacctcgtgttcagggacaccgacgtcttactgagttcactggcagccgccaggtctgtgaggtacagcaggtatgctgacgatctcgtgtttagcgggttggctcccgcaccagccgatttgcagaccacagtgaaagccgtgctgctggacgctggctggaagctagcaatcgagaaggaacatcttgcggcgctacctaaccgactcaaggtgcacggcctgctcgtgcatggtagttccccgagattaactaaggggtaccggaaaaaaatcagagcctatcgccaccttacccgggtcggcaaggtgaaacccgctgacgcaagcagaatagccggacatctggcttacgcttcttctatcgagaaatttactaagagcaaagagtga

SEQ ID NO: 14116 - RNA, 960 nt, unidentified
  source 1..960: mol_type = other RNA; note = synthetic construct
atgaatacgcccccgctgcccttgctcgtaactttcagcagcctgccagacctgcttttggccctgcaacttgaggaagaagatcacgaacgcaaaactcagatagaggctctgcacaggaagtcactgcccccggtaacaagtacccttgcactctcaaccatgtttggcatatccctgaactttatccatgcgcttgcccggcatccagaaaagaattatcgcaagttcaagattcgaaaaggtaaaaagaaccgggagatctcttcacctaggatagccttaaagctcattcagcgttggttcgcccagcacgcaagctctgcgctggtcttcccagagtacgtgtgcggctttgtccccggaattaatggggtgacagaagctgcaaaaagacattgcaatgcaaaatgggttttcagcgttgacctgagggattttttcggacaggtgtccagggcccggatccataacaagctcgttgctttggggtacccagagtctggggctgatctgatttgtcaactgtgcctactggacgacaaactccctcagggctcgcctgcaagtcctttcctgagcaacttagctttccaagaaaccgacgagaaattgaatctcattgcctccaagtttaaatgtagatttagccgatatgccgacgatatcgtcttctcaggcaagaatgagtttgatcccattatcgagaaggaggtgaaggaactcttagaacaggagagatgggtgctagctgaagacaagacagagatctcccagctacctcacagactgaaggtccacggactcctggtgcacggcgacaaaccacgcttgaccaagggttacagaaacaggatccgtgcctataaacaccttctgtctaatgagcgcatccgggcggacgatatcaacaaggtgaaaagtcatatttcctacgccaacattatcgatagtatatga

SEQ ID NO: 14117 - RNA, 1110 nt, unidentified
  source 1..1110: mol_type = other RNA; note = synthetic construct
atgcgcatcgcactggagtgtgagggccgtggacagaagggcgcctgtaggactacagccgatccttcaaacagacccccgtttgggcgccgccacaatgagtcccatcatagctttgccctcccagtgaacacaccacccctgctcgtgtgttttccatcactggataccgcaagtaacgcgttgagtgagagaacaagacaggcttacggggaagaattccgtgggcttatcgagaggaggctgccacccgccgtaagcattcgcatagttgctactttgttcggtttctctccttcatttgtgggtgctatggtgcggaggccgggaagatactacagggtgttcgagattcggtctggcacgaagattcggaaaatccaggccccccgtgttgccctgaaagtcatccagcaatggataggaggtcatttggctgtggccattccttatagatcttctaccttcgggtttgttcctggccggagccacatagatgccgcaggacagcactgcggtgcggaatggagctacagcattgacataaaggacttctttcaatccacctcagaagaggccgtacgaagggccctgatggaactcggctactctgaacatgcctcccacctcgtgtcctccctttgctgcgtcggcggttatctggcacagggggcacctagcagccctgctctgagcaaccttgttttcctcaattatgacattcagttcgaacagtacgcggccgagcatggcctaacgtatacaaggtatgccgacgatatcgtattttccggcagaggcgagatccccgcgagtcttcccgagctggccaagagaaccattgagtccggcggatggcaaatcgctccagaaaaagaaaagacccagcggcggccataccgactgaaagtgcacgggttgctagtggaggggatcagtccccggttaactaagggataccgccggcgaatccgcgctctgagacacctcatggagcacgggcgagtcgcagcagatcagctggctaaggtcgcaggacacttaaattatgccgaacaagtcgcttcatgggctaggaaaagtgaacgctcttcggaggtggacgagtga

SEQ ID NO: 14118 - RNA, 987 nt, unidentified
  source 1..987: mol_type = other RNA; note = synthetic construct
atgaatacacctcccctattagtaacattccctagtcttgacttctttgtctcagccttggcagaagatacgcgatcgctgtatgaagccgagatacgcggcctggttgagctcggtttgcctcccgtcgtgtccttgcgaaccatcgccgtgttatttggcttttccccatcttttgtcggcacgctggcaaagcgaccagcaaggtactatagggtatttgaaatccggaccggaaagaaggttagatttatacaagcgcctaaggtggctcttaagctcattcaaaggtggattggcgggaatctagccagcacatttaactacttggactccacattcggtttcgtgccgggacgttcccatattgacgcggccgcaagacactgtgagagtaactgggcctacagtgtggacatcaaagacttcttccggactactagcgctgccagagtccgtactgcactccttaagctcgggtattctggtcgggccgctgatctgacagtcgccctgacctgctacgaggggttcttagcgcagggagctcccacatcacccgtgttgtctaacatcgtttttcgcgagtatgatcagctcctcgaagagctggcttgcgaactgaacctcactttcacccggtacgcagacgatatagtattctcagggaccggggccccaattgctgagctgaaggatcgggtgagaagcatcatcgaaagcggagggtggaaaatttccgagaaaaaagagaagctgttccagaagccctacaggcttaaagtgcacggcctccttgttgatggcaccgtcccacgcctaaccaagggatatagacgcaggatcagggccctgaaacacctgctgagtcagggcaaggtgcctccgaaacagctgcgcaaagtgcagggccatctgaattacgctcagcaggtggatagctggctggcctcacaagctgcaactgacggagacgaatctagctga

SEQ ID NO: 14119 - RNA, 1101 nt, unidentified
  source 1..1101: mol_type = other RNA; note = synthetic construct
atgcgaatcgctttaatttgtgaggatcacggacagaaaggcgcctgtcggacagccgcagctccttcagatagacctcctttcggtcgcagactaaatgaatccaacctcagcttcgcattaccggtcaatactcctcccctgctggtgaacttccccagtctcgacttcctcctgaaggctctcgcagaagaaacgagggagattcatgccgacgagatcagattccttatcgaacgccagttgccaccagcggtcagtacaagggtgatcgcaacactctttggcttttcccctttgtttctgagtgcaatcgctagacgtccggataggtattaccgccaatttgagatccgcagcggcgctaagctgaggcagatccaatcgccaaaagtggcccttaagcttatccagcggtggattgggggaaatctggcaacatctctgacctatcccgactgcgtttacgggttcgtcccaggcagatcacatatagaggctgccgccaaacactgcggcgctgactgggtatacagtgcagacgttaaggacttcttccagtccacctcctttgacgccgtgcagcgtgcgcttaccgaggttgggtatcagcctaaagctgcccaattggtggccacctactcttgcttcaagggctttctggcccaaggtgcaccgagctctcccgtactgtctaacctggtttttctgccttacgatagacagctattagagtatgccgtccagtgtgatattacgtacactcggtatgccgatgacgtggtgctttcagggaggggtcagcccccagaagatctgaaggcgtttattcatcagactatagaagcgggaggttgggtgctcagcgagcgcaaagaaaagctgtccgtgaagccacaccgattgaaagtgcacggactgctggtcgatggggactctccccggctcaccaaagggtatcggcataggatacgagctttgacccacctcctggagaagggaagcgtatcacccgagactatgagcaaagtgctaggccacattaactacgccaagctggtcgccgagaagggacgggacgaaggacagggcggcgattga

SEQ ID NO: 14120 - RNA, 987 nt, unidentified
  source 1..987: mol_type = other RNA; note = synthetic construct
atgaatacacccccacgactcatcttattttcatctctggacaagtacttgcaggctctgggcgatggcttcgatgaggctcacgtcgacgccattcggtgcctggatagcaaaggttatccacccgtagtcagtatccgggcattatccgtgctgttcggttaccgatcacagtttgtcggcgccatgcttaacagaccccagcattattataggcgcttccagatcaggagtggtaaaaaacagcgtagaatagacgcccctcgcgtcggactgaagatcatccagaagtggtttggccactatctggctagggccattaccatgccggacgtggtagtagggttcgttcccggccgctctatactgcacggagcagcaatgcactgccgggccaaatgggtttttagtacggacattaaagatttcttccagtccacccctaccgcgattgtcaagaacgcgctcgtggatattgggtataccgaacatggcgccgagatcgctagcggactgtcatctttgaatggggttctcgcgcaaggatcccctgcctctccagtgttatcaaacctggcctttctgaaggtggacaggcaactgcaagaatactgtcatgagagagggcttgtctacactagatacgcagatgacattgtgatctccggcgctggtaagccgagccctaacataagctccgacgttcgcggaatgatcgagacaggcaattggcagttgtccgaagagaagactactttgcttagcctccccaacaggctcaaggtgtacgggctacttgtggaccaggcccgcccaagactgacaaaagggtaccggcgacggctccgtgcaattcggcatctagtggatagtggcaagatcgatgctcagaatgatccaaaggcatatgaaagagcctgtggacacctggctttcgcccaatctgtggaggattttagcgacagggtgcagaaagactcgacatga

SEQ ID NO: 14121 - RNA, 963 nt, unidentified
  source 1..963: mol_type = other RNA; note = synthetic construct
atgaatgcccctcccctcctagtctcgttcgactcactgcaccggctgtttctggcctgcggcgttgaggataattcaagcgcagccagttccctctcagcactggtggagattgggtttccacctatcgtgtcaaaggctacccttggggtactctttggttacagtcctcggttcataggagctatgtgtaaaaaccccgaccggtactaccgaactttctatctgccaaaaggaaatggcaagttcagaaggattgacgccccaagggtggctctgaaagttattcagaaatgggccggctttcacctggcaaacaatctgaagctgtctccctctgtggtgggtttcatcccgaagatctctgctattgatggggctgctcgccattgtagccaggactgggtcttttctaccgacatagagaacttcttccaaacaactgcccagagtcgcgtgacgcagtccttgatcaaattcggctttcccgcggaaggtgctgagttattttccaagctttcctgcttgaacgggaacctagcacaaggcgccccttgcagccctgtgttatccaatatctgtttcagcgaatttgatgtcctgatcgagaactattcccttgacaatgagctcgtgtacacaaggtacgccgacgatatcgttatttcaggtagggggaatccgccacccgatctcgaaaacaagatcctcgaaattgtaaccgcagccggatggtccatatctagtagcaagaccagattcagtcgtcgccccaaccgccttaaagtctatggcttgctggtttctggcgacgtccctcggctgacaaaagggtaccgtaatcgaattagagcgttgaggcacctggaaaactccggaaagctttctccagaatcggaggatgtggccctcggacatttaagctatgcaaagagcgtggagagatttggcctgggaagctga

SEQ ID NO: 14122 - RNA, 975 nt, unidentified
  source 1..975: mol_type = other RNA; note = synthetic construct
atgaatattcctccgctgctttttagctttacaacccttgatcagcttattagtagtctggacgaggaaacgcgacattcaaaagaaaacgagatcgcttcactcttcaagaataaactgcctcccttggtgtccatccaggtcttatctactctcacaggcttttccatcccgttcatatatagcatgaccaataaaccagagaagtactaccggacattcatcatcagcaccggaaagaagaaacgtataatacactcccctcgggttagcatcaaaatcatccagaagtggctggctcaccacatctcctcttctgtgaacttcaacgagtgtgtttacgggtttgtgaaaaagaagtcacacattcttgccgcgagtaagcattgcggttcagattgggtctacagcgtggacatcaaagacttctttcccagtactacgattgaaaaggtgcgcctgggtctgattgatattggctattctgagaaagctgcagatctgatttcgaagatctccagcttcgaatcctgtttggcccaagggtcgccactaagcccctgcctgagtaatatcgtcttcaaaaacgtggacaataatttgtgcgagattgcaaagaactacgagctcacctataccagatacgccgacgacattgttttctcaggcacaggaaacaaaccatcccagctgagttctgcaataaaagatgagatcgaatctgctggctggaagctcgcccctgggaaggaattttattcagaccggaaagaccatctgaaggtccatgggctcttagtaaacagcaatcgacctaagctcggaaagaggtatagaaacagaattagggcctatgagcacctattgaggaatgacaagatatccccagccgacaagcccaaaatcatgggacacgtatcttaccgcgatagcgtggatactctgggcaagaaagaagatactacccccgcgtga

SEQ ID NO: 14123 - RNA, 1134 nt, unidentified
  source 1..1134: mol_type = other RNA; note = synthetic construct
atgaggggcgggaacggggacaggttaagaacagccgtctgctgtgctcgcgtgtgcataacccttacatgcgaagacccaagcaccgagggaaggctgcccaatggcggacgaagctttgagtctcccgcagttcgacaagccgctagcaccaaagccacatccttcgcgctgcctgtgaataccccgcctccccttctgtattttggcagtgtggacgagctgatcgccgcattgtcccccgtgactagagagagatacgaatatcagattcgcactatctgcgacttaaatctgcctccagctgtttcaatccatgtgattgctacattgtttggatacagtcccagctttgtagtggctttgctcaagcgccccgagcgttactaccggatattcacaatccgtagcgggaaaaaaagaagagaaatcgtcgcccccaaggtgtctgtcaagattatccaacggtggattggaggcaacatagaacggcatatcgaatggctcccttgtgtattcgggttcgtgtccgggaggtcttccatcgatgccgccagcattcactgtggcgccgactgggtctactctatcgacctgagagatttttttccttcaaccacgagggcgactgtacaggcagcgctgactgacattggctacgagccacattgtgctgaattgatcgcacggctcagttgctatggaggacggcttgctcagggtgctccatcttcgcctgttctctcaaacctcgcgttcatgcgcttcgatcagagactcatggagctgagcaacgccttcgatgtcaaatatactcgctatgccgatgacatggttttctcgggcaacggaacgttcccagctgcccttaagggggagatagaggccgtgtttcgagatagtgactggaagtttgccggcgacaaagaatacttcgccgagaaaccatccagactgaaggtgcacggactgctggtggatggtggggttccgcggttaaccaggggttacaggaataagattcgcgcatttcgtcacctaatgtcaaccggccgagtccgcgaaaaggatgtctctaagatttccggtcacatcgcatatgcaaatctagtgctgaggaaagcaggccggtga

SEQ ID NO: 14124 - RNA, 1089 nt, unidentified
  source 1..1089: mol_type = other RNA; note = synthetic construct
atgtgcatcacgctcatctgtgaggatcgaacaatcgaggggagacttaccaatggtggacgctcctttgagtcaccagctgtgcgtcaagcagcagccactaaggctactagtttcgcccttccagtcgatacaccactgcccctcctgtttttcgagtccatagacgaactggttggcgccttgtctcctttgaccagggagcggtacgaacctgaaatacgaaggctctttgatgccaggttgcctcctgccgctagcatccatgttgtggcaaccctgtttggctactcgccctcatttgtggtcgccctgctgaaaaggccggagagatattaccgtacgttctatatcaaaagtggaaagaaagtccgcttaattaacgcccccaaagtttcaattaaaattatccagcggtggataggtggcaatatcgcgcgcaatgtccagtggctgccctgcgtgtttgggttcgtgccggggaaaagcagcgtggacgcagcgagagtgcattgcgaagccgattgggtgtacagcgtagacattaaggacttcttcccctccacacgctccgaatctgtgcaagttgctctcattaaactaggttataaacctcacgcagccgagctaatcgctcgcctttgttgtcacggcgggcgtttagcccagggagctccatcaagtcctactctttctaatctggtcttccagcccttcgacgaacagctgcaacggctcgcggatactctgaacgtgaagtacacaaggtacgcggacgacatggtgttttctggtgaaaacgccttcccagaaaaactcaagaacggcgtatccgaaattttcttaaagagcgattgggtatttgcacaggagaaggagtattttgcaaagcggcccaccagactgaaggtgcacgggcttctcgtcgacggacgggttccacgcttgacccgaggatatcagaataagattcgggcttacaggcacatgctggaggctggcaaggtggctaagacagatatcgagagaatcagaggccatgtcgcctatgccgacctgatagagaagaagactaacctgaccaaatga

SEQ ID NO: 14125 - RNA, 978 nt, unidentified
  source 1..978: mol_type = other RNA; note = synthetic construct
atgaggttgccccatagtctcttgtccaacccgttctttcagttttctagactgtctgatctccttgcagttctgggaaacgaggtcggcgagctggagatcgaagaaattgagcacctctgctcaattggcctaccgcctgtcacgagcgagaatgttatatgcgccgtctttggattcaatcccgggttcgtgtggagcctcctgaacaaaaagcacaaatactatcgccgtttcgaaattcctaaagggcagggcgtgagggtgatatatgctccacggctgggcctcaaggtgatccagaagtggctgtcattaaggctgtcagaattttgggtccctgatgactccgtctacgggttcgtggtgggcagatcacacgtggacgcagcagccaggcattgtggagctcggtgggcttttagctgtgatatcgaaaacttcttccctagcacaagccaggcgtccgtagagagagctctgattggcatcggatacaaggagaaatctgccaagctcatcgccgaagtttgctgttaccaaggtgccttagcccaagggtcccccgctagtccagtgctgagtaatatttgcgccgctggtctggataaaaagatgcttgccgtccgagacaaatatggctgcgtctatacccgctacgcagacgacatggtgtttagtggcgagggggagatgcccagagagcttgaagcggatgttttgtcctgtttcgatggtgaagagtgggaagtggccgaagggaagacttactcggcagtttatccaggacggatcaaggtgcatgggctgcttgtaggtggcggagtaccccgcctgaccaagggatacagaaatcgattgcgcgcataccgtcacctgctagagcgggacgccgtagtgaagaacgctagcgttgtgatgggccaccttgcctatgaggactttgtgaggcggaaagcgttaccagagtctgaatga

SEQ ID NO: 14126 - RNA, 969 nt, unidentified
  source 1..969: mol_type = other RNA; note = synthetic construct
atgagattgccccaatcactgatttcatctccactgttccagtaccatcgagtcagtgatctcctagctgcactcgacggtgagatcgacgatgaggaagttagcgaaatacagcggttgagtaacctggggctgccccctatcacctccgccaactgtttagccgctatttttggcgtgaatccaaagtttatctggagcctctgtaacaggcgctccagacattaccgacacttctccattcctaaagggtccgggatgcgtgacattcacgctcccagagtggggctgaagctgattcagaaatggttatcagtccggctcagccaattctggggcgagcgcgagggagtgtatgggttcgtaactggccgctctcatgtagatgctgccgcccagcattgtggcagtgattgggtccttagctgcgatattgagaactttttcccgagcaccacagaactgttcgtgatacagtcgttggaggcgatcggatacaggcactcgagcgccgcgcttatagctagcctgacatgttatcagggtggacttgcacagggatctcctttgtcccccatcctttccaacatttgcttcaatttcctggacatcaaattcttggtcctcagggactcaataagtggagtgtacacgagatacgcagacgacatcgtgttttctgggcggggcggttttcctgaaggcctgctggaacagattaggaattgctttaaaggcactccgtggtgcttagcagataataagaattacaaggccatccgcccatgcaggctgaaagttcacggccttctggtggatggggacaagccacgtctaaccaagggttatagaaacaaaatccgggcctattcttacctcgtggacaataagaagattaccaagcacgagtctatcatcctgggacacctcacttatgccgagtttgttacaatccatcaacagggctga

SEQ ID NO: 14127 - RNA, 1032 nt, unidentified
  source 1..1032: mol_type = other RNA; note = synthetic construct
atgaggaagcaattagaagcactattgtctatgagacttcccccgtactttttcagcaacccatatgtggttttccccactcttagtgactttatcaagagcttggaaggcgagattaccgacaccgagctgcaggaagttaatcgactggccgccctcaacctgccccctgtagtgtcggggagtgtggttgccgccatctttggagttaatccaggcatcgtgtgggcgataatcaacaaacctcacaggtactacaggaccttcaatattccgaaaggaaacgggcagcgggagattcacgcccctagagtggtgcttaagatattccagaagtggctatctgtacgtcttgcagatgcttggcgcccagcggactgtgtctacgggtttgtggcgggacgcacatatatcgacgctgctatcaaacataagaacgccaagtgggtgttcagttgcgatattcaagaattcttccccagcacacctagtatctatgtcaaagaatgtctccagagactcggttacaatcacgaccaggccgccctggtgtcctcactgtgctgtttcagaggaggtttggcccagggatccccagcttcacccgtgttgtctaacatatgcgccgatgaccttgataagcagttactgcgcgtggccgagaaatatggctgcaattacacgcgttatgcggacgatgtcacgtttagcggatctgcagaggtccccagcgggctcactgacgatgtcgctggcgtgtttcatgcaagcccatgggagctggccccagggaagacaaaactgtccgtctcccctgctcgactcaaggttcatggcctgctggtgcacacaggcactcctaagctcaccaaagggtaccggaataagttaagggcttatcggcatctggcagcacacggtaaactgaccaaaaacctctcaaaggtcaatggccacctgtcctacgcagctgacgtggatcgccgggtagctgccgataatattgaggtagagaacctgtttggcccctga

SEQ ID NO: 14128 - RNA, 972 nt, unidentified
  source 1..972: mol_type = other RNA; note = synthetic construct
atgcggctacccctccacctgcaaagttcaagatactttacattcggcaccctgcaggagttcataaaggcgtcaggcacctctacggacgctgaaattgctgaatatgaacgactggaggctctgggcctgccgcctatcagctccaggcattctctggccctgatgctgggggtaaacccagcccttatttggagcttcgaggcacggcctcaccggttttatcgaacttttcacattgctaagggcagatctactaggcgcatagacgcccctagggtcggattgaaaatcgtgcagaaatggttgtccgctcaattacaggcggcctactctccacccgagcatgtttacggatttgtgcccaaccgcagccatgtgcaggctgcctccattcactgcggagccgaatggattctgagcgctgacatcgctgattttttccccagtaccccatttgcgctggtggaggccaatctgaaacgccttgggttcaatgagtatgccgccagaacaatcgcttccttgagctgtctcgatggggcacttgcacagggggcccctacttctccggtgttatcgaatatatgctttgacgagatggacaaggccctactggcactcgcaaccaaacatcaggcccgcctcagcaggtacgccgatgacatcgtcttctcaggttccggcgaggtgtctgaaaccttgatctccgaaatccgagacttattcgtacagagtccatgggagttgtccgaaagaaagtttgtcctctcgcgtcggcccaaccgcctgaaggtccatggcctactggtggaggataagaggcctaagctcacaaagggatatagaaataaactcagagcgttcaggcacctgcttgcaaacggtcgggttcgtagcgcaaaggatgttgagattatggccggtcaccttgcatactcagatttcgtggagaaaagtttcgaaacatga

SEQ ID NO: 14129 - RNA, 1116 nt, unidentified
  source 1..1116: mol_type = other RNA; note = synthetic construct
atgcagcatgctcattgcgccaagaccaacgacagacggatgcccagcttcggccgatgcagctttgaaacacagcccaagcgaaggcacctcgatgagtcacaactgtgttacatgcgcctccctcatcaactacttgagagccctttcttcctgttttctcgcgtcgaagaacttgtcgaggctatcggtctggagacaggcgatgacgaggccatacagctgagagcgctgtccgaacggggattgccaccggtgacatcggttcactgcctcgccacgatgctgggggtgaaccctgggctggtgtggagtttgataaacaggccacaccgttactacagaacattcgagattccgaagggcaggggtactaggcgcatcactgccccaagagtcgcactgaaagtcatccagaagtggctgggatatcatctggccagagctgcctctacccccccacacgtctacggctttgtgcccggcaggagccatatcgaagccgctcacgtgcacaggggcgctgaatgggccctgtcagtggacatcgctaatttcttccagaccacccccagttccttggtgattaatacattagagcacctgggctatggagttggtgccccactgctggcctcactcacttgttacttaggctttttggcacagggggcgccttccagtccggttctctccaacctttgtttcgcggcaacggacgaggtgctcgtgcgcttgagcgagcgttacggttgcaaaatcactcgatatgcagacgacgttgtgttttctgggcaaggtggcatgcctggaggactcagaagcgagctgcgggggatttttgcagctaccccttggaaactctcccctgagaaggaaagtgtacagcccatcaaaggccggattaaaatacatgggttactggtcgatgggccacatgtgcggcttaccaagggctataggaataagctccgcgcatacgaacacattttgcttactagaggaggggaagccaccgatcggcatgtactgtctggacacgtacagtatggacaccacgtggaagccattctagagcgtctagctctttctcgcgcaaatgagtcacccgattga

SEQ ID NO: 14130 - RNA, 1128 nt, unidentified
  source 1..1128: mol_type = other RNA; note = synthetic construct
atgagattgccgcagcacctactggcatcccccctgttcgtgttcaagaatgcggaagagcttatcggggccatgggcgatcgatccacaccggaagccatcggcgacatcaggacactctctgcccaggggctgccaccagttgtgtcagaggaggctttggcagcgatggtgggaatcaactctggcctggtatggagttttctgaaccgtacctggaaacactaccggacgtttgagattcctaagggcaatggcgtacggcagatcaacgcgcctcgtgtggccctcaagattgtacaaaagtggttgagtgttaatctggccaaattctatgaagcccccgaacatgtcttcggttttgttgccgggcggagccatattgatgcagctatgaggcacattggagccaaatgggccttcagcgccgatatttctgactttttcccttcaacacccgaggccatggtggcagaagccctccagaccatcggatactccgaccagagcagtcgcatcatcgctagactcggctgtttgggagggcgccttgcacaaggtgcacccacatcacctctgttcagtaacctgtgctttcgccagatggatagcgcagtcctggagctgtcgcataagtatgaatgccgcctgaccaggtatgctgacgaccttgttttttccgggcagggagacttccccaatactatacgggacgacttgactgcactgtttgctaacggcccgtggcacctggctcctcagaaaatgttagtgcagccactgaaggggagaatcaaggtgcacggtctattagtgaatgattctggcgtgaggctgacccgaggataccgcaaccagatcagagcttacgcccacctcctcgccactaggggggatcaagccatggaggcgccaaaattaattggccatgtcgaacacgctagacatgtgcagagggtgaccgggagcccctcaggtatatctaagaatgagggtgtcgaacgtgagcgcatcataattcctccaggaattattctcccagaccgacaacctagcgctgatgatcggcggcccgaggctcagaatgagtccttcgtcggctggcttaaaagaatacttaacttttga

SEQ ID NO: 14131 - RNA, 978 nt, unidentified
  source 1..978: mol_type = other RNA; note = synthetic construct
atgagacttccgctgccactccttaactcgcagtatttccagttcagcagtttcgccgagttaagaactgcccttggcgactcagtgtcttctgaggagctccaagaggccgcaaggatcgtattgggcgggctgccccccatcacatctaggttgacgctggccgctatgttgggtgttaatcccgggcttatttggtcctttgagaacaggccccagcgctattaccgcagtttcagcatcccaaaaggaaggaccacacgacagattgacgccccaaaggtcgcactcaaactcatccagaagtggctgtccgtccagctggcaaggacttttgaacctgctgaccacgtgtacggctttgttggcggacggagtcatgtgcaagcggcggcacaacatgttggcgctcagtgggtgtttagcttagacattcaggatttcttcccatcaacccccattcgactcgtggtcgagagccttaaaagtctcggatttggaagcgatggggcatccctgctatctcgtctggcatgcctgcgaggtgctttggcccagggagctccatcatcgccgatactgtccaacatctgtttccaacagatggacggtcagctcgcccaaatcgcccagaatgtgggcgccagactgacacggtacgcggacgatgtggtattttcagggataggcgagatgcctcctacactagaaaatgatgtccgcgctatattcaccgacagcccttggactctggccgaacataagatccgcattgcccaggtgcctgacaggctcaaggtccacggccttctggtgcacggagcccagatccgtctgaccaaggggtatagaaacagactgcgcgcatatcggcacttgctgcacgaaggtaaaattcgggatgatgacctggctaaggtgtgcggccatttaagctacgctgcgtccgttgagcgggaatccgatgggacctcttga

SEQ ID NO: 14132 - RNA, 975 nt, unidentified
  source 1..975: mol_type = other RNA; note = synthetic construct
atgaggttgcccccatcactgctgaatagtcagtatttcctgttcagcaacttcgccgagctgcgtaaagctctgggagattctgcatccagcgaagagctcgaagaggctgcaagacttgtgctcgcaggcctccctccgataacctcgaggttgaccctagcagccatgtttggtgtcaatccgggattgatctggtcttttgagaacaggccaagacgccattaccgaagtttttccatccctaaagggcgaaccactcggcagattgacgccccaaaggtcgcgctgaagttaatccagaaatggctttcagttcagctggctcgtacttttcagcccgcagaccacgtgtacgggttcataagtggacgtagccacgtgcaagctgccgccagacatgtcggtgcccagtgggtgttctccgtggacatccaggactttttcccttctacgccagttgatctcgtggctacagcattagaagcgctagggttcgggagagacggcgccgttttgcttagcagactggcatgtctgaggggtgggctagctcaaggcgcgcctacatcccccgtactcagcaatatttgctttcagcacattgatgggcacctggtacaaattgcccataatgccggggctcgcctttcccggtacgctgatgatatcgtgttctcaggaattggcgacatccccccaatgttggagaacgacgtgcggacactgtttgatggatcaccttggactctggcggagcaaaagatccggaccgtccgagcccccgataggctcaaagtgcacggactgttagtccacggtgcccaggttagactcacaaagggctatcgcaacaggcttcgcgcatatcggcatctgctgggcgaaggcaagattcaggaagccgacctcgccaagattcgcggccatctgaactacgctgcctctatcgagcgggatggcgacgagatatga

SEQ ID NO: 14133 - RNA, 942 nt, unidentified
  source 1..942: mol_type = other RNA; note = synthetic construct
atgtacacaagcctcggcgagctctcacgtgccttaggtgatgccgcacgccctgaggaactggcagaaattgaaaggctcgtactccttgacctgccacccgtgagttctcgaatacaattagcaaccattttcggagtcaatcctggccttatctggtcctttgaaaatagaacccgcaaacactataggagcttctttattcccaaggggcagactactcggagaatagacgccccaaaggttgcactgaaggtgattcagaaatggctgtcagtccacttgtctcacggctttaagccagcagatcatgtgtacggcttcgtgtcagcccgatctcatattcaggctgctacccttcatgtggatgcccagtgggtgttctccgtggatatccaagacttctttccgacaacccccatccagctcgtgtcggacagcctggaggctattggattcgggagagatggggccatgttagtagcccgtctatcttgcttggccgggttccttgctcagggagcacctacaagtcctgtgctgagcaacatctgttttcgcctgatcgatgaagcattgatcgcgatagccgctcggtactccatacggctgaccaggtacgctgacgacatcgtcttttccggcactgaggagtatcccgcgcagctggaaactgatgtgagggccctgttttccgttggtccatggacattggcggagcataaagttcgcgtcaacaaactaccggagaggctgaaggtacacgggctgcttgtgcacggacccaagattcggctgacgaaaggctaccgaaacaagctgagagcttatcggcacctcatgacgcatgagaaggttgccgaagcggacatcgctaaaatcaaaggtcacctcaattatgccgctagcgtcgataagttcagagacgccagtgaggactga

SEQ ID NO: 14134 - RNA, 975 nt, unidentified
  source 1..975: mol_type = other RNA; note = synthetic construct
atgaggctcccacaaccgttattggattcccagtactttctcttcagcagtttcgccgagctgtcgaaggcacttggagaagccgctcacccgggtgaactcgcagaagcggaaaggctggtactgcgtgggttgcctcccgtcacttcaagaatggccctggccacaatgttcggcattaaccctggactgatctggagctttgagaatcggcccagacagcattatcgctcattctctattccaaaaggcagaactaccagacagatcgatgcgcctcgggtcgctttaaagctcgtacagaaatggttgagcgtgcatctgagccgggcctttcagccagccgagcatgtctatgggttcgtctccaatcgtagccatgttcaggcagccgcccgtcatgtaggtgcaaggtgggtgttctccgtggatattcaggactttttcccctcaacacccgttgatctggtggcggaaagtcttcagaccatcggtttcgggcacgaaggagcccgcctgctatctcggctggcatgcctaaggggcgccttagcccaaggcgctcccagttctccagtcctgtctaatatttgttttcagcacgttgacgagcagctcatccttatagcttcccggtacggggtgcgcctgacacgatatgccgacgatatagtgatcagcggtacggacgagttgccacctaccctagagaacgacgttcgggctctgttttcacagggaccctggagactcgctgaccaaaaaactcaaatagcacaactgcctgacaggcttaaggtgcacggcctgctggtgcacggcgagaaaatcagattgacaaagggctatcgaaaccgacttcgcgcctacaggcacctgatcagtcgcggaggcattcaggacgcagatctcgctaaagtgaagggacacctcaactacgctacctccgtggacaaggaggggggggatgcatga

SEQ ID NO: 14135 - RNA, 912 nt, unidentified
  source 1..912: mol_type = other RNA; note = synthetic construct
atggatgaattactgaaagcatctgcaggtgccgtgccagaggctgagatgaacgaagccagaagactggtcaatctggggctccctccagttacctcacgcatggctctcgccacgatgtttggtatttccccaggcctgatttggtcctttgaatctcgcaccaggaaacactaccgcaccttttttatacctaaaggaagcgggaagcgtcgaatcgatgcgccccgcatagccctcaagatcatccagaagtggttgagtgtgcacttgcagaagtgctatcagccccctgaacacgtgtatggattcgtgtctgctaaaagtcatgttgcagctgctgcccgtcattgtggggcaagttgggtgttctcagtcgacctaaaagatttctttcagagtactcctgaggtggtcgtcatcaactccctggagcgaatgggattcgctgtgaacagcgcgactctgctggccaagctatcctgtctcaatggaaccttggcacaaggcagcccgagctctcccgtattatccaacatttgcttcgagcatgttgatgagcagctgctcaagattagcaagatgtacaatgtgcggctgtcaaggtatgcagacgacatcacattctcaggcacaggcgtgtttcccgccgcccttccagaggaagttctcggggtcttcgaagagggtccgtggaggttagccgaacagaagactgacctggcgatgcttcccaacagacttaaagtacatgggttgctggtgcatggcaaccacgtccggctcacaaagggatacaggaatagactgagagccttccggcacctgctgaagaatcacaaagtatcggatatggaccttgctcgggtgcaaggccaccttgagtacagcgaatttgttgagaggttctga

SEQ ID NO: 14136 - RNA, 966 nt, unidentified
  source 1..966: mol_type = other RNA; note = synthetic construct
atgcgcctccctcatccactcttaaactctcaatttttccagtacgcatcactttctgaactcttgaaagcaacagagcgggctctctccgaatcggaacgcgagcttatgctgcaattgtcagggaaaggcctgcctccgatcagtagcagggcggcactggcagccatgttggggataaatgaaggcctgatttggtcctttgaggcaagacccggccgacattaccgtaccttctatattcccaagggaaaagatgtgaggcgcatcgacgctcctcgggtagccctgaagatcgtgcaaaagtggataggttttcagctagccaaggcgtatttgcccccagagcacgtttgtgggttcgtggagggcagatcccatattgacgcagctcgtattcactgccgcgctacatgggtgttcggagtcgacatccagaactttttccctaccactccaattgatgtggtggcaagggccctcctggatatcggataccacgagctgggagccgttcttatctctaggctgtgttgcttcgaaaacgcgttagcgcaaggggctcctagttctcccatactgtccaacatgtgctttgctagctacgatcagcgactgaaggctatcgccgacaggtatggagcaagactgactagatacgccgacgatatcgtgttcagcgggcaggatgactttcccgtcgcattaaaagaggaggtacttggtatcttcgccagcgggccgtgggccttgagtaatcagaagattaagctggccgtgtggccacagcggctaaaagtccatggcctgctggtccacggcgaccagcttcgactcacgaagggttaccgcaatcggctccgggcctatgagcacctcctagctgctggcaaaattagggccgaatcaatcagcgtcgtgagaggacacctgggctataaggaccaggttgccaaaagagcctga

SEQ ID NO: 14137 - RNA, 966 nt, unidentified
  source 1..966: mol_type = other RNA; note = synthetic construct
atgaggcttccgcagcccctcctggacagccagttctttcagttctcctctctcgctgaactgctgaaggccacaggagagttggtcccaccctcagagcaggtgcaaatgcggcgaatggtggatagaggccttccacctatcacatccagggccgccttgagtgcaatgcttggcatcaatcccggtcttatgcatgcctttataacatggccccaacgctactatcgtacttttgaaatcccaaagggacgtcggggcgtgagaaggatagatgctccgagggtcgggctgaaaatcatccaaaaatgggttgccgagcgactccaaaactgttacgagcgccctgaacacgtttatggattcgtgtccggcctgagtcatgtacacgctgctgcacagcactgcgaggcaacctggacttttggcgtggacatcaaggacttctttcagaccacccctattaacgtggtcactaagtgtctcctacagattggattcgacgaaaatggtgccgctgtagttgctagtctctgctgcctgaacggagtgttggctcagggcgccccatcatcacctgtgttgtctaatatctgtttcctgcacgtagatcagcggctcgcagaactggcggccgagtttggagttaggctgacgcgctatgccgatgatattgtctttagcggcatgggtgagtttcccgagcgtctgcagacagaattattcgccattttcagctctgggccttggcgactgagcgagcggaaaacccgcctggacaaactgccaaacaggcttaaagtgcacgggttactcgtccacggggaaagagcaagactaacgaaggggtacagaaatcggctgcgcgcgtatgaccatttagagagaaccaagggggaagacgtggaggatgcggacgtcattcggggtcatctgtcctacggcaagttcgtggagtcgttgtga

SEQ ID NO: 14138 - RNA, 963 nt, unidentified
  source 1..963: mol_type = other RNA; note = synthetic construct
atgcgtcttccccagcccctgatcgaaagcaagttttttcagtttgagcgcctcgccgatttagagcgcgcgattggcgagcatggaagcgccctggaactcgcagaaattcgcaggctaactaatctgggcctgccgcctatcgcatcctcgagcaccctcgctactatgcttggagtcaacagggggctgatttggagtctggtgaacagaccccggcggtactacaggcgattctcaatacccaaagggaaagaagagcgcataattcatgctccaagagtggccctgaagattccacagaagtggataggagtgcagctctctaactatttcagggctccagctcatgtgttcggcttcgttcctcaccggtcccacgttgacgccgccagagtgcatttgggcgccaaatgggtcctgtctctggacatcgagaatttctttccgtccacccctcaagagcttgtagagcaggcactggtcaatatcggtttcggagaagcaggcgctaatctaattgcttcactggcctgtttcaacgggtttttggcgcagggatctccttgctcccctacactgtccaactattgcttttcaccctgggatgagtctcttgcgttattggctgctcgagaaggcgtgcgcattagtcgttacgccgacgatatcgtgttaagcggtcacggtacaccacttgacgggctgcaggaacaaatcgccgccacactggccaatagtccatggcgactgtcacagaggaagatcagcttgagtgtggcacccgcacggctcaaagtccacgggttgctggtaagcggagacagagtgcgtctgaccaagggctaccggaacaagctaaggaccttcgagcacatcctccaaacgagagaaaatctcgatgcgaagttcgagagaaaagtccgggggcacctcgcatatggcaaatttgttgaggcctga

SEQ ID NO: 14139 - RNA, 981 nt, unidentified
  source 1..981: mol_type = other RNA; note = synthetic construct
atgcggttgcctcacctattcctcgacagactctgcttcggcttgtcaggtcctgaagagctgttacgagtgctggggcccttagcatcacctggagaagatgagtgtataagaagactctgtgcgctggatctgccgcctgtgtccagtcccagggctttggctgccatgctgggcgtcagtgagggacttgtctggagcatgctccaccggcagcatcgccactatcgccatttttccatcccaaagggaaggggtagccgggacataacggctccccgagtagccctcaaggtgattcaaaagtggctggcggtgagactccaggcgaaatactacaggcctggccatgtgttcggcttcgtgcccgggctttcgcacatcgacgctgctcgtcagcatctcggagccaggtgggtgtgtagctttgacattgagaacttcttcccgacaactccagagggtctggtcgcagcccgtttagtagatctcgggtttccagagtctggcgctgggattgtggctcgactggcctgcttctcaggtgtattggcccagggagccccaactagccccgttctgtccaatatcgcattgtgcgacatcgatcaacgcctcagtctattggctgagcggtacagtctgagactgacccgatacgccgatgacattgtttttagcggccttgaggcagtgcccgaccagcttgcacgcgaagtgtatgaactattcgccgctagctcctggaggctgtctgaagcaaaaaccgagagagtcgaaatcccttcacgccttaaggtccacgggctgcttgttcacggcgaggaagttagactgacaaaggcatatcggaataggatccgtgcctatcgctacctgatggagaggaacggaattcagcaggcggatctgccaaaggtgaaaggccatctgtcttttgccgaatctgtccggaaagccgggggagcctcctttggctga

SEQ ID NO: 14140 - RNA, 981 nt, unidentified
  source 1..981: mol_type = other RNA; note = synthetic construct
atgcggctcccccaaccattgctggacagcccatattttcagttctccactgtgaatgagctttgtaaggccgctggtgaccctgacagcgcggaagtgatggagatcaggcgccttgacgcactgaacctgcctcctgtttcctcccggcagatactcggactgatgttcggactcaacagtggactgatttggtcttttcagtctcgcacccataggtattacaggacattcaatatccctaaaggcaatcggcagagaagaatcgatgcaccgtgtgttggcctcaaggctattcagaaatggctggccacacagctgcagggcgcctataaggtaccggaccacgtctttggttttgttgctggccgctcacatatcgacgctgcgtctgtccatgcccaggccgtctgggtgctgagtgtggacataagggatttctttcaaaccacgcccaagtctctagtcaaaacccgacttctggaattgggattcctcgaaaaaggggcagagttaattgcttcactgtgctgcctgagagacaacttagcccaaggcgcacccacctcaccactactgagcaatgtgtgctttattcacgtggatcaacagttgagctacctggcggataaatacaacctccgtttgagcaggtatgccgacgatattgtgttcagtggtaagggacagtgtccagatacccttcgggacgagcttgagtcccttttcatcgggagcacctgggtgttggctcccgagaagactgagctcgtctcgctgcccaaacgcctgaaggtgcacgggttactggtacacggcgaaaatatcagactcacgaaggggtatcgtaacaagatacgaacttacaaacacctattggcaacaaaaggggccgagctgacaaattcagaaaaaatcaagggccatatttcctacgaaaagtacgttgatctcgtggtagatgcccagagaaacacttga

SEQ ID NO: 14141 - RNA, 945 nt, unidentified
  source 1..945: mol_type = other RNA; note = synthetic construct
cggcgaaccttttataggcgatcaacaaaggaaaagctttgttatatgcgactaccccagctacttcaggaaagtcagtttttcttgttttctggcgttgaagagctgctgtcggcacttggctctgtcatcgacccggcggagaagcaggaggtactgagactggcagacctggggctccccccaatttccagtaaagatgccctcgccactatgctgggaatcaacccgggactgttatggtcttttgaaaatcgcccacagaaacattatcgcgtgtttaccatcccaaaaggcgccggccgtgagcgtacaatagtcgcccccaaggtggcattaaaggtgctgcaaaaatggctgtcaatccagctccaaaggaattacgtgcctcctaaccacgtgtttggattcattcctggccgcagccacattcaagctgcccagaaacacctgtgtgcaaggtggacctattccgtagatatcgaaaattttttcccaaccacatcccgcgatgtcgtgtgcgaggtgttcttgcagttggggtactctcccgagagcagccagatgctggctggtttctgctgctacaagggcttcctcgcccaaggggcccctactagtcccgtcgtgagtaaccttgcgttccggaacatcgatgagaggttggttcagctggcagaacggtttggggttaggctcagccgctacgccgatgacatagtgtttagcggtattcacgatttccctgacgagttacggattgacgtagacagaattttcggagattccccatggagactgagccccgacaagactgagttcgaccagttgcctcggaggcttaaggtgcatggtctgctcgtccatggggaaagagtgagactaacgaaaggatacagaaataagctccgggcttatgctgctgtttcactgtacacatcctga

SEQ ID NO: 14142 - RNA, 972 nt, unidentified
  source 1..972: mol_type = other RNA; note = synthetic construct
atgaggctgccaccactgcttctggaatctcagttcttcttgtttagctcactggaagaattgctagcagccttaggggacagcgtcgccgagctggaaaaggaggaggtggcacgacttgcggctctgggcttaccacctatctcgagtcgggacgctctcgcgaccatgctggggatcaacccgggcctcgtgtggtcctttgaacacaggtccgccaagcattaccgcaggtttacgattcccaaaggcgctggacaggagcgggtaatcatcgcccccagggttgccttgaagattgtgcagaagtgggtaagcgtgcaactccaacgcgcttatgccgcacctcaacacgtgttcggatttgtgccagggcgctctcatatcgacgcggccaagcagcatagactggctgagtggacttactctgtagacatagcagatttcttcccgtcaactcctctcagaacagtgactgccgtgtttaatcggctcggatatggggatgaggtcgccagcatgcttgcctccctgtcttgctaccagggcttcctggcacagggtgctcccacaagccccgtcatatccaatttggccctgcacgaggtggacagacgtctgattgacatctcacggtcatttgatgtgagagttagtcggtatgcagacgatattgttttttccggccagaacgggttccctgaagaactcgtcgatgaggtgaacgagattttcatcgacaccccctggaccataagtcaaggaaaaacagagttgaataggctccctcgcagactgaaggttcatggccttttagtgcacggtgctcaggccaggctaaccaaaggctaccgaaataaactccgtgcttatgctcacctgattaaaaacggtctgatccaggaaggacataagcttcgcgtcaaaggacacctacgatacggtgagcaggtcaaggaggccgcagattga

SEQ ID NO: 14143 - RNA, 972 nt, unidentified
  source 1..972: mol_type = other RNA; note = synthetic construct
atgcgactgcctctgttccttcaggactctcagttctttttattcagcagtgtggaggaactggtggctgccttgggagattccgttgcagtggtggacaaggaggaggtgaagcggctagcagagctcgggttgcctcctgtctgcacccgggaagtcctcgccacaatgctcggcattaatcccggcctcctgtggtcatttgagtaccgcccggataagcattaccgcatatttagaataccaaaaggcgcccgcggcgaaagagaaattgttgcaccacgggtcgctttaaaaatcctgcagaaatggctatctgtgctcatgcagcgtcactacgctgcgcccgatcatgtattcggattcgtgagtggtagatcgcacctggaagctgcgaaagttcacagaatggctcactggaccttctcagtggatatcgctaacttctttccctcaacgccagcctatgtggtcgccgaggcgtttgaatccattggatttggtgccgagtccgccgaaatgctcgctagactcacctgttatcgggggttcttggctcagggagcacctaccagccccgtgatgtctaatatcgccctgagagccgtcgacgagaagttgtccgacatctctcgaaggttcggggcaaggctgagccggtatgccgatgacattgtgttcagcggtgtagaggagtttccagagggtctgcgagccgaagtggcagacttaatgacagatactccttgggaactgagtgcagagaaaactgaatttaaccaactgccggggcgtctgaaggtacatggggtgcttgtccacggaccccaaatcaggttgacaaagggctatcgcaacaagctgagggcttacgcccacctgagcaaacggggccgtatccgccaggacgatcttcttagggttgccggccatatcaggtacgggattcaggttgaggaggtcgcggactga

SEQ ID NO: 14144 - RNA, 996 nt, unidentified
  source 1..996: mol_type = other RNA; note = synthetic construct
atgcggttaccacacagcttgttagagtctcagttcttcgcccttacctcagctaaagaactggtaatcgccatgggggactcactgagcgaggaggagtcggatgaactacaccgcctcgcagggctcggattgccacctgtttccagtgccctggcactcagcaccatgatgggtattaatcccggactgctctggtctatgctgagtagacctactcgccattaccgcagattcacgattcccaaggggaggtcagagcgcgtgatcttcgctcctagggtggcattgaaaatcatacaaaagtggctgagcattcactttgagaaacgttttacaccactgccacacgtttatggcttcgtgcgagggaagtcccatatccaggccgccaaaatccatactacagcacagtgggtgtactccacggacatcgagggcttttttccctcaacccctatcggcttagtggttgaggctctcatgtccctggggtacaatgctgactctgcagaaatgttggcgaagctctgctgcatcaacggccatcttgctcaagggtccccggcctccccggtaatcagtaacatcgtcctcagacacatagatgcgggtctgcagcggattgccggagactttggttgtcgactgagccgctatgctgatgacatagtgttcagtggcgctcagacccctccagctgatcttggcgacgttgtcccagaactgtttttggacacaccctggcgtcttgctcccgaaaaaacccacatttctactgcccctcgaagactgaaggtgcatgccctcctggtgcacggagccgaagtcaggctgacaaagggatacaggaatcggctgcgggccttccggcaccttataaaaaacggaagagtgagggaggcagacctaaagaggattcagggccacctacattatgccgatcatgtggcggcagaatctgtcgtcaacggcgatggtagcgccattccctga

SEQ ID NO: 14145 - RNA, 1047 nt, unidentified
  source 1..1047: mol_type = other RNA; note = synthetic construct
atgtctctgacgcggggcccttccaatcgggaatccagcagtagacacctcacaaaggactcattcgcgaaaatgcgcctgccccatcatcttgtcgagtcgttgctctttcagtatgaaacggtcgacgacttagtgctgagcctgggatcagaggtaacccctgctgaagttctggacattaggagactcgtcgctttgggccttccccctgtcatcagccgagatgtgctggcaaccataatcggcgtgaatcccggtctgatttggagtatggagagacgacctagaaagtattaccgctacttccctatcaaaaagggggtgggtgaacggcacatattcgctccacgggtggccctgaagatcatccagaagtggcttagttatcagtttgctaggacatacctcgccccaccacatgtttttggcttcgttgcgggaaggagccatctgcaggccgcaaatgcacactgtggggctcgctgggtgcatagcgtggatattcgtgatttctttcctagtatcaccgccaatgtgctatcttcaaaattggtcgaactcgggtacaacgacctgtctagcgacttcattaccaaattttgctgccttaacggtcaactggcacagggagccccaacctcaccgactttatccaacctcgtgttcagggccatggacaaccgcctggtcgagatcgcagaaaggttcggggcccggctctctaggtacgctgatgacattgtgttctccggaactcagcaatttccggaagatctgccagcatgtgtagaggagatatttgtaggccaaccatggcagctggctcccgagaagactgagacagccatattaccccatcgcctgaaagtccacggactattggttcacggccacaaaatccgtctaacaaagggttaccgaaaccggattagagcctatgagcacttgcaggccaatgggaggatcattgatgaggacgcgagaagagttggaggccaccttatgtatgcccgccaggtggaatcctttatcgtgcccgattga

SEQ ID NO: 14146 - RNA, 975 nt, unidentified
  source 1..975: mol_type = other RNA; note = synthetic construct
atgcggctgccccatcctttagtcgagtcgctgctcttccagtacgaggcagtggacgacttgatccttagcctggggtccgatgtgacaccagatgagactgcagatattcgtcggttagtagctctggggctgccccccgtgatctcaagagacgtgctcgcgaccataattggcgtgaatcccgggttgatttggtcaatggagcgaagaccacacaagtactacaggtactttagcatcaagaaaggtattggtgagcggcgaatcagtgccccacgcgtggctttgaagataattcagaagtggctatcttgtcaattcagcaaagtctacgtcgcaccccagcatgtttttggattcattgcaggtcggtcccatctccaggccgcccatgtccactgctcagcaaactgggtgtactctgtcgacataaggaacttttttcctagcatcaccgcgaacgttctctccggcaccctgatggatctcggatattccgcacctagtgctgacctgatcgttaaactttgttgcctcaacgggcaactcgcccagggtgctccgactagtcctcccctaagcaacctggtatttaggggcatggactccggactgctggagatcgcccagagattcggcgcccgtctgtctcgctatgctgacgacattgttttttctggcacggaacaattcccgcagaatcttccagctacagtggccgagatcttcgccggccaaccatggcatctggcgcctgaaaagacagaaatcgccatccttccaaatcgcctgaaagtgcacggccttctggtacacggagatcagattagattgaccaagggctataggaatagaatccgagcttatgaacacttacaggccaacgggaggattttggaaggagatgcagctcgggtgggagggcacctgatgtatgcccgccaggtgaaaaatttcatagcccctgattga

SEQ ID NO: 14147 - RNA, 963 nt, unidentified
  source 1..963: mol_type = other RNA; note = synthetic construct
atgaaactgccccgccactttgtggagtccacgttcttcatgttcgaatcagctgccgagcttgtgactgcgttggggcctagagtgggcctgggagacgtagctgaaatccacagacttgcccagctggggttgcctcctatcattagtcgtgatgcattagccgttatgatcggcgtcaatcctggccttatctggtccttcgagaaaaggccaggcaggtactaccgacactttcagattccgaaaggctctggcgttcgtaacatcgctgctccgaaggttgccctgaaggctatccagaagtggctgtccatccactttgaaaagtgctttatgccccatacccatgtctacggcttcgtgcccgggcgctctcatctccaagctgcaagcgtacactgtggtgcaaaatgggtgttttccgtcgacatacgcaacttcttcccctctacttccgcccacctcgtgaagcgcgcactgaccactctggggtactcggccgagtcaagcgacttcctcaccaaatttctgtgcttggcgggcggactagctcagggatcaccagcaagccccgtgctgagcaatatggcctttatcgaagtggacgccttactggccgcaatggccgcgaactatggagccagactcagcagatatgcggatgatatagtattcagcggtgtgaatgagtttcctcccgacctacctgtccaaattgctcaactcttcgcccggctcccatggaatattgccccagagaagaccgaaacagcaattgccccacagaggatgaaagttcacgggctgctggtgcatggggaccagattcggttgacaaagggataccggaacaggataagagcttatcagcatcttatgacatcaggaaagatccgagatgatgattggaggcggattaagggtcacttaatgtatgcacggcaggtcagttctagttga

SEQ ID NO: 14148 - RNA, 969 nt, unidentified
  source 1..969: mol_type = other RNA; note = synthetic construct
atgaggttgcctcagactctgctgaactcaatcttctttaccttcgccctagagcaagagtttgtgtccgcttttggaaccagcctccaggcaattgaacgttctgaaatcgagagacttgcagccctgcagctccccccaatcacttctgaggatgccctggccctgatgattggagtgaatccagggatgatctggagcttggtgaacaggaattacaagtattatgacagcttcgtgatcaaaaagggggccaaagaaagaaggatctcagctccccgcgtctcaatgaagctaatccaaaagtggatctccctccatcttgaaaacgcttacgaccctcctgaccacgtttatggttttgtcgccggccgaagccatttggatgccgctagtaagcactgtgaggctcagtggatccacagtttcgacattaggaatttttttcagaacaccccatcgaatgtagtggagaacagtctgcttgagatcggctacaaagagccatctacggatattatcgtccccttgtgcacactcgcagggttcctggcacaaggagcgccaacctcccctgttctgtccaatatggcgttcaaaaaagtggacgcgcagttagccgaggtagcagccgctgaaggcctgaacttaacacgctatgctgatgacattgttttctcaggcataaaagcaccgaatagcgcactgattgagattataaagcgcatactggctcagacaccttggtctttagccgaggaaaaatcccattttagcgaagctcccaatagacggaaggtgcacggtcttctggtgcacggcaacaagccccggctcactaagggataccggaaccgaataagaggcttcgaacatgccatgcataaggggaagatcaagccggaggatctcattcggattaagggtcacctgaattacgccgcctacgtcgaaaaaaaattcatatga

SEQ ID NO: 14149 - RNA, 972 nt, unidentified
  source 1..972: mol_type = other RNA; note = synthetic construct
atgaggctcccgcaacacctctcctcctccccattcttctcatttagcgagaaggacgacttctttaaggctatcaagaccgtggttgacgatgacgagttggagaggattcatttactgatcgcacgcggcttaatacccattactagcaaagaggtgcttgcgaccatgttgggcgttaatcccggcatcatttggtccatggttaaccgacctcaccgctactatcggtccttcagtattcccaaggggaaagaaaaaagggaaatcctggccccaaaagtcagcctcaaagtcattcagaaatggatctccgttcagcttcagaataatgtgacatttctcgaccatgtgtttggcttcatccctgggctcagccacattgacgccgcctcgcagcatacagaggcatcttggatctacagtatagatctcgaaaagtttttcccttctactccacagagttgggtcgaggcctcgcttggaatactggggtacgatataaaatctgcctctctggtgggagatctgtgctgttacggaggtgccttggctcaaggggcaccgagtagcccagtactctcaaacatttccatgtctggggtggacggatcactatctgctctggctgcggaactgggcgtccgtgtcacacgatatgccgatgacattaccttttccagtatttacgagttccccgaggctctacccgcaagactgagcgcgctgttcaaagacacgccttggagcatcagctctaagaagacacacttggctaagtcacctggccgccttaaagtgcacggattaatcgtaaatgatggtcaggtgaagctgaccaagggctatagaaacaagctgcgggcctacaagcacgtgatcgaaaaaaacaagtgcagagataaggatactgctaggctgtcaggtcatctgagatatgcagcccagatcgagcggcataacggtgaatga

SEQ ID NO: 14150 - RNA, 969 nt, unidentified
  source 1..969: mol_type = other RNA; note = synthetic construct
atgcgactgccacaccaattaaccgggtctaggtttttctcgtttagcgacgaaggagagttcctgaaatcggtgtctgcggtagtggacgaggaggaattcgtgcgtattggtagtctggtgcaggccggccttatgcccatcacctcaaaggaggtactggcgactatgctaggggtcaaccctggcatcatttggtccctcgagaataaaccagaacgatactatcgccgctttaagatacctaagggtaagggcgaaagagaaatcgtggcccctaaggtgggtttaaaggtgatccagaagtggttttctgtgcagctgcaggattgtgcccgcatcgacgatcatgttttcggttttgttcccggcaggagccatattgatgccgcctctgtgcacacaaacgcaaactgggtctactctatcgacttgaccaacttcttcccaagcacaccgattaattgggtcgctagcagtctgattaatatcggctacgatgctgatagtgcagaccgaatttccaaactgtgctgctatcgtggagctctggctcaaggatcccccgcctcacccgtgctgtcaaatattagcatgagagggatagatgccgctcttggcgcattggcggccgagatggatgtcagggtcaccagatacgcagatgacataaccttcagtgccgctggagagttcccccaggttctcccggaaagactcgagtcccttttttcacagactccttggaaaatcagccaggagaagacttattttagcgaggcaccagtacggttgaaagttcacggactcgttgtgaacggcaatacagtgaaactgacgaaagggtacaggaacaagctgagggcctatcggcacgtgttgcagacaaatcgctgtagacaggaagacctagcacggctctccgggcatgtccggtacgcttcccaagtctcctctcgggacgactga

SEQ ID NO: 14151 - RNA, 978 nt, unidentified
  source 1..978: mol_type = other RNA; note = synthetic construct
atgcgcctaccccacaatctcgtggaatcacagtttttcattttcagcgaaagagaggattttttgaaagcagtggattcagtggtcgaccacgaagagcttcagagaatcaataagctcatcgagggagggggaatgcctattacctcaaaggaggtgttggcgactatgtttggcgtgaaccccggcatagtatggtctttcatcaataaaccagaccggcattacagaaagttcagcattcctaaagggaagggaaagaggagtatactggccccgaaagtggggttaaaagttattcagaaatggatctcctaccaactccagggcaaagcacggtttcctgatcatgtgttcggattcgtgcctggaaggagccatatagatgccgccgtaaggcatacatccgctaggtgggtttacagcattgacttggaggacttctttccttctaccccacgatctctgatcgcgagttccctttgtagttttggttatgacttcaagagttcagagctgatttcgaagctgtcttgctatgacggcggtctggcacagggtgctccaagctcccccgttctcagcaacattgccatgtttgaagtcgataccgctctggccgagctggctgaagagcttgggatacgcatcacccgttatgccgatgacatcacgttttcctccgagggcgtgtatccctcctctctgccagaacggcttagcactatcttctatagtacaccctggaagatctctaaaaagaagacatacttctccgtcgccccgaagagaatgaaggtgcacggtttgatcgtcaattgcggcgaggtcaaactgactaaaggctaccggaacaagttacgtgcttatcgccacgtactccagtcggggctatgcaagaaagaagatgcatgtcgcctggaagggcacctgaactactactcacaagttattaagcaccgagacagcagcacatga

SEQ ID NO: 14152 - RNA, 918 nt, unidentified
  source 1..918: mol_type = other RNA; note = synthetic construct
atgggtaaaaagctaaaacggggcgaagccgaggagatccaaaggcttgctgccctgggcctgccacccatcacttcccgttggtgcctcggaaccatgctgggggtgaatgcaggcatcttccgctctatggaactgcggccccacaggtattaccgaaacttcagactggccagtggcaataaggtgagaaatataagggcccctaaggccggactcaaggtggttcagaggtggatagctcataacctggcaaatgcctacgtggccccggaccacgtctatggctttgtctctggacgctctcatatagacgccgctatgcagcacgttaacgcgagctgggtggtgagcgtcgacatctccgacttctttccttcaacacctgtcagtgttgtgcggtccaggttgctgtctattgggtaccaggaagtggccgccaacctgattacctctcttgttacatacgaggagagcctacctcaaggtgctcccacttcaccagtattgtccaacatttgctttggcccatcggatcttaaaatggcagcaatcgctgagcactacgatgcaagaattactcggtatgccgatgacatagtcttcagtggtgaaaccggcatcccgcatgctgacatcctcgtaagcgttagggatcattttgaacggacatgttgggatattaatgagcgaaaggtacgaatttcacaggcgcccaatagacgtaaggtgcacgggctcttagtgcacggtggaagcgtccgcctcacgaaaggatacagaaatagaatccgcgcgtataaacacctgctgaacacccgcagtgatattccacaggaggactaccattcaatcatggggcacgtgagctatgcagatcatttagctgagttggtggggaagtccgactccaactga

SEQ ID NO: 14153 - RNA, 969 nt, unidentified
  source 1..969: mol_type = other RNA; note = synthetic construct
atgcgcctgccacacaatctcctcgaaaatgtagggttgttgacagacggcccaaaggagcttatcgcgagcctgggtgagggatgcggtgtggaagaggcggatgagattgtgcgcctgttctcactgggactgcctccggttacgtctctgaaagctctggcagtcatgaccggctacaacccaggattcatctggtccttagtcgaccgacccgaaaaatattatcgagttttcgacatccccaagggccgacagctgagaagaattgaggcaccccgagtggctctgaagctcatacaaaagtggttttctctacactttgagcgtcagtggaaacctcatgatgctgtgcatggctttgtgagggggagatcccacctcagcgccgcaaggaagcacgtgaccgccgaatgggtggtcagtgtagacattgagaattttttcccctccactctcaaaaccgatgtccgggccgccctggttcgtcttggctatcgctcagaagagtcgcttgcaaccatagaacggctctgttgccgctatgagcgcctaacacaaggcgcaccatcatcccctgtggtcgccaacattgctcttgacttgctagaccagaaaatagctgccatcgcagatcaccatggagtgatcttcacacgttacgcggatgacattgttttgtctgggcgggacagggctcctgcaaacatcctggaagaactgactgccatcttcgaggggactagctggcgccttagcgcccagaagcagagcgtgtctcacctcccggacaggttaaaggtacatggactcctggtccatggcgagcacgtgaggctgacaaaagggtacaggaacagattaagggcctttcggcacctgagtgatcggggcgccattcgggaagctgatcaaagacggattagaggacatttgaattacagtcagcagatcgagagaggtgggtga

SEQ ID NO: 14154 - RNA, 966 nt, unidentified
  source 1..966: mol_type = other RNA; note = synthetic construct
atgggactcccccatcacgccgtgtactcccagatgctgtgcgctggttctgagcaggatctcctgttaggcatgggcgctttctgctccagtgcggaggcggaagaaattagtcgcctgactgctttgggactcccgccggtcacttctctagaagcacttgccgtcatgacggggtttaaccccggtttcttgtggtctttacagaacaggccagaccggcagtatagggttttctcaattcctaaggggaagacatttcgtcagatcgaggccccaagggtgggcttgaaatttattcagaaatggctcagtatccacttcgagcataagtggagcgcacaccctgcagttcacgggttcgtgaagggccggtcacatattaccgccgctcgagtacacctgaacgctcagtgggtgatcagcgtggacctggagaattttttcccatccacaaaagtggatactgtggagaaggcactcagaaagctcggctacaaaaccgacgccagcatctctatcttgagtagcctgctgtgttttaagttaaggctgtctcaaggggcgcctacatcccccgtgatctcaaatatcgctctgtccgatatagacgataagatcagccttatagcacagaattgtggagctaggtataccagatacgccgatgatattgtactgagcgggacactgtccccacccgagaacctgctgctagccattaagaacgtctttgaaaagacctgctggagacttgccgaacgtaaaacgtcaactgttcagctccctcaacgcttgaaggtgcatggccttctggtccacggtgaaaaaatcagacttaccaaaggatatcggaataagatccgggcattcaaccatctgttcgagaaagacgccgtgaaagccgaggacgcccaacgaattcgcggacacgttaattactcgcgccaaatagaaagagtctga

SEQ ID NO: 14155 - RNA, 969 nt, unidentified
  source 1..969: mol_type = other RNA; note = synthetic construct
atgagacttagccacaagtacattgaaaaaatcgctctggtggccggatcagccgaggacctcatcacagccttgggaaactcgtgctctcccgaagaaaaggctgagattcaacgcttagtggacgccggccttcctccagtaacttcctctgacgccctctcagtgatgaccgggttcaatccaggctttatttggagccttgtgtcccgacctgagaagcagtatcgggtgtttaagattccaaagggcagagaagaacggcagattgaagctccccgggtcgcgctcaagctgatacagaaatggttttcagtccacttcgagaacaagtgggttgcacattccagcgtgcatggctttgtgcggggtcgcagccacatctctgcagcaaagtcccacctgggagccgagtgggtggctagtgtagatataaggaacttcttcccgagtaccaccgcgtccgaagttgataatgcgctccgcgatctcgggtatggcgacgagagtatcaagctattgaaacgcctgtgttgcttcgggggcagattatcccaaggggcccctacatcacctatcctgagtaacatcgcactccataggatcgacttggatgcctctaatgtggccattgagctgggagccgtatatacacgatatgcagacgacatcgtcttcagcggaaaaggtctgccccccccagatgtgctggagaaactggagaagctctttaccggaacgtgttggcagttatctgaaaggaagcgccacattgctcagttgccggggcgtctgaaagttcatggccttctggtccatggcgacaaagtcagactgactaaaggttaccgaaatcgggttagggcatacaaacacctagtgagcaaggggaggatcaacctggatgacagaaaccgtatcggcggtcacataaattacgctaagcagatagatgaggcttctgattga

SEQ ID NO: 14156 - RNA, 978 nt, unidentified
  source 1..978: mol_type = other RNA; note = synthetic construct
atgagactcccccataatttaatcgaacgactgaccctggtagcgggcagtccagacgaactatgctccgcgctaggtgatgccgcaggtggagaagaagtcgccgagataggaagactgagtgccgcagggctgccacctatcacctctctcaacgcactttcagtgatgactggctataatccaggctttgtgtgggctttggctaacaggaccgctcgctactatagagtttttgagataccgaaaggccgaggcactcgtcaaatcgaggccccgcgagtcgctcttaaactgatacagaaatggctgtgtcaccatttcagcgccaaatggcagcccctggatgctgttcacggtttcgtcccaggaaggtcgcaccttacggccgcaagcgtgcacttacgcgcggaatggatcctcagtatcgacctggaaaatttctttccctccacacctattgaccagatcaggggatcacttagaaaactggggtatcaggatggggacgggctggagttgattgcaaacctcctctcttttaggggacgcctgtcacagggagcccccacaagcccagtgattagcaatattgcattgagcgacatcgatgggatcttgtccgacattgcccggaatttcagaattagattcactcggtacgccgacgacattaccttctctggcattagtggtgtacaactgcctgacgagctgctcgcatctgtccgggagcagtttgtggggacaccttggcgcatctccgagaggaagattcatatcgccaagtcccccgctcggcttaaggttcacggactgctggtgcatggcgatgagctacggttgacaaagggctatagaaaccgcctcagggcctaccggcatctgatgcagctcggcaggatagatgcttcagatttaggcaaggtgaccgggcacatgaactacgctagccaaatcgagcgtctgaagtcttga

SEQ ID NO: 14157 - RNA, 972 nt, unidentified
  source 1..972: mol_type = other RNA; note = synthetic construct
atgaggctgcctcatcacaacctagaaagtgtctgtttcctgttcgagcacttttcggagcttataaaagccatgggcgataaatgccccccggaggaagcaatcgagatcgagcggctgttcaatctgggactccccccggtgacctccgagaatgcacttgccaccatgctgggctataacccaggctttatttggtctttattaaacaggacgagccggtactaccgtcagttcgatatccccaaaggtgccggcactcgcaagatcgatgccccaaagatcgccctgaaggcgatccaaaaatggctctcatatcacttccagaagaagtggatccccaatgaacatatttttggctttctgcctggaaagtcccacatggacgcagcgagcaaacacctcagcagtaaatgggtgtatagcatagatatccagaattacttcccttctatcagtacagtgcgcgttagagacgcattggagaacctggggtattctaccgagccatcattgaaaattattcccactctctgttgcctgcggggatcattagtacaggggtcaccagcttcccctgtcttgagcaacattgtgctcaaaaacctggatgaagaattggccaatttcgctcgagaaaaaaactggaagtttacaagatacgctgacgacattgtattttccggcattgacgacatcaacgagagcgattttatacctatcaagcttttcgtcaaccaggacgggtggatgatctctgataagaagacttacctcgcacgtcatccaaataggctgaaggttcacggtcttctggtgcatggtgacaccatacgactgacaaaagggtatagaaacagaataagggcttttcgccacctcttgaatgctgacaagattaaggaacaagacctagccgttattcggggacatcttaattactccgcccaggtggatgatttccagctgtga

SEQ ID NO: 14158 - RNA, 960 nt, unidentified
  source 1..960: mol_type = other RNA; note = synthetic construct
atgcgattgccacagccccaattagaatcgataggcttcctgtttgaggccccatccgagctgattcaggccatgggtaacgaatgttcccctgacgaggcagacgaaatccgacggctatacggcctggggttaccccctgtgaccagccaggagtccttaagcgtaattttcggctataacccagggttcatttggagccttcttaataggactccgagacactatagacattttgaaatccctaagggcgccggacatcgtcagatcgaggctcccagggtcgcccttaaggccatccaaaaatggctgtctcaccacctccagagggcgtggactccgaacgagaatgtttttggatttgtgcctggacggtcccacatcgatgcagcagcgaagcatctgtcaagcgaatgggtgttctctgtcgaccttgaaaattttttccctagcgtgtctatccgtcgcgtgaaggaggcactcagaacagtcgggtaccaaacggataaatcagtggagatcttgagtactctctgctgcctggataaccatctggtgcagggatcacccaccagtccagtgttgagcaatatagtactaaagaacgttgatcagcagttcgcctctattgctgctgagaaaaagattgtttttacacgctatgctgacgacatagtgttctctggcagtggtgatatcccacaccagaccctgacacagatcaagtcggtcgtctccgacgatggatggaccctctccgaacggaaagaacggctcagcgagacacccaatcgcttgaaagtacatggcctcctcgtgcacgggcgcaaactgaggctgaccaagggttataggaatagaattagagcttaccggcacctgctgaagaacgagaaaataaaggaggaggacctgagtaagattaaagggcacctgaactacgcctcacaagttgaatga

SEQ ID NO: 14159 - RNA, 972 nt, unidentified
  source 1..972: mol_type = other RNA; note = synthetic construct
atgcggttcccccatcctgacttttccgaactgtgcctcttcgcacaaaccccagatatcctgattaaagccctgggggatttcagtgacgacgaggaaaggcagctcatcttagagtattgtgctcaagacctccctcccgtgacatcagtgatcagccttgcagtaatgaccggctttaatccaggcttcatttggagtatagtttctagaccacacaagcattacagatcattcccaattctcaaaggaaaaaacgcccctccccgcataattaatgcacccaaggtggggctgaaagctatccagagctggctttctatccactgggtgcgcaaatttgaccaccaccctaactcatttgggttcatccctggacggagccacgctcatgcagctaggtgtcatgtaggcgccgagtgggtgttcagcgtggatattaaggatttcttcccgtccattcaggaggaccgtgtcttgaaggccctgcagtgcctggggtacaaggctggtgacggcactaccctgctgacccgcatgctgtgcctggatggtgccctctcccagggatccccagcatctcccgttatctctaacatgatactccgaggtctggatgagcggctgttggcccttagcctcgaactgggcatcgtctttactaggtatgctgacgatattgtctttagtggtaagggccagccgcccaaagcgctactagagaaggttgtgaatgaagttaacggggacggatggacgatcgccgaagacaagctgtacacatcgattcttcctgcgcggttaaaagtgcacggccttctcgtccacggggcgagtgtacgtctgacaaagggatataggaatcgaataagagcctacagacacttgttggccgagggcaaaatcagcaaggatgatttatcatctgtgctgggacatgtctcctatgccgactttgtggagaagttgtga

SEQ ID NO: 14160 - RNA, 1014 nt, unidentified
  source 1..1014: mol_type = other RNA; note = synthetic construct
atgcgactgccacacccaaggacggagcagctcggatttctcgctgaaacccccaaggaggtgtgcaaactcattggcgccagctgtggggaagacgagcagaagttgatccagcaatactacgaactaggcctgccgccggtcacctctgtcaatgctatctccgtgatgtttggatacaacccctcttttacatggtcgcttctgaaaaattcacacaagttctacagggtgtttgagattccaaaaggacctaagaaaaggaatattagtgcccctaaagtttccctgaaggtaatccagaagtggctggcgacacatttctacaataaatgggaacgacctgactatgtttttgggttcgtgcgcggtaagtcccatattggcgccgcccaggagcatatcggtgctaattgggtgataagtgtggacatagaggattttttcccaagcattcggtggactagagtgtatgatgccattaccgatctgggatatcaggacgacttcagcaagcaggccttaactcttctttcatgctattacgggagccttgcacaaggagcgcctacttcccccatactgtcgaacataataatgggccccctggacaagaagattttcgaactcgcacgccacaacagcgctacttatacccgctacgctgatgacatcgtgatctctggtaaggacggcgagcctaacagtctcctggaacaggtctgtacgctgatcgagtctgatggctggaaaatcagcgttcagaagaaaaagatccaaaagtcccccaatcggttgaagatccacggcctattagtgaatgataaaaacgtccggttgacaaaggggtaccgtaaccagattagagcctacaaacatatcttgaacaacaactccatcgatgacgaatcaaaaaataaactcagagggcacattgcatatgccgatcacgtagcaacctattctgagcaactgcctccacccagtacaccatcaagcaagctgcccgtctga

SEQ ID NO: 14161 - RNA, 981 nt, unidentified
  source 1..981: mol_type = other RNA; note = synthetic construct
atgcggttcccccaccccgacctggagaaaatatgctttattgcagaagacccggataccctaattaaacttctgggcgaacactgcacagcagatgaggccgcactaattcagcagtgttgtgctagtaggctccctccgatctcctccccagacgccatcgctactatgttcggctataaccccggctttgtatggtttatgcttaccaagaccaaccgcctgtaccgcacattctttataccaaaaggcaaaggtgagcggcagatcaccgctccccgagtgtctttaaagcttatccagagatggttgaatttccattggtctgcggcttgggtggctcctgattgcgtccatggttttgtttcaggaaggagccatgttactgcagccactgagcactgcaatgcgaagtggattgtgagcgccgatatcgaggactttttcccttcagtgaaaaccgcccgtgttagacaagcactcgctgaactgggttacgctaacatggattcattggccctcctcggaaaactggtgtgtctcaacggagctctcacgcaaggcgcccctacaagtccattactgagcaatatcgtgctgggccagctggaccggaacctgaccacattagctgaagaactcaacctggtattcactcgctatgccgacgatatcgtgttctccggaaagggggagatgcctgaggggattgacaagaagataaaggccatcattgagcaggacggatggacggtcgccgaaaagaagttcgaggtcgccaaggccccctctaggttgaaagtgcatgggcttcttgtccatgggggtaaggtgcgtctgacaaaggggtatcgaaatagattgagagcatttaggcacgttctgagcaatgggaaagcctccgaaaaagatgtgccaaaactgtcgggccacgtcgcatacgcggacttcattgacctgcagcaccggaagccagattga

SEQ ID NO: 14162 - RNA, 990 nt, unidentified
  source 1..990: mol_type = other RNA; note = synthetic construct
atgaagccaccacatccatcttcgttttccgtgggcttcctaaccgagagcagcgacgaactcattaggatcataggtaatagggtcacggaggaggaatctcagctgatacggcaatactttgatctgaagctgcctcctatcacttctgtcccagccctcagtggtatgttcggacttaacgaggggttcatctggagcgtgatcaaccgggcgacaaagcattatcgacgctttgaaattcctaaaggcaggaccacccgaactatctttgcgccgaaggtgggcctgaagatgattcagaagtggctcagtattcatttccaagaatgttggtccagcccccgctccgtgttcgggtttgttcctggaagatcacaccttgccgccgctgcacagcatctggggtcagaatgggtgatgagcatcgatattaagaacttctttcccagtacttccacacagaaggtggaagcagcattggggagacttggctataatgacgagttcagccgcatggccatcaccaaactaacatgcctgcggggtggactcgcacaaggagcacccagtagccccatcttgagcaatatagtactgcacgatctggaccagcggttatctcagtacaccgaggccaacgacctcgtctatacaagatatgccgacgatatcgtgatttccggcaacgactcaccacccaatgatattattgatgatgttcgctcaatggttaaagatgatggatgggagatcgctgagtctaaaacgtccttggataggattcctaatagactgaaggtccacggcctgctggtacacgggaaacagatcaggttgaccaagggctaccgtaataaaatcagagcctaccagcatttacttgctaacaacaaaataactgacgaggacttttcaaagatttccggtcacatccgttacgctagttctgtggaaaaattcgacacacacccggacaattacgactga

SEQ ID NO: 14163 - RNA, 1479 nt, unidentified
  source 1..1479: mol_type = other RNA; note = synthetic construct
atgaagatcaattttaatgaggacatcctgctgtgggcaattggggtgcttcagcccgctagcgctagcgatgcgctgaaattcatatcctacatctatccagaaatcaaaccactcccactggtcaaggaaatagatcaggttctcagccggtaccgggacctcggtatcgtggtacgcgtgcacggcaagtctaggctgtactcactgacatacgccggaaatgctaagctgtcactgaaattgcggcgccatagggataaagcccgtctctttcttctcaaagacacaaggaagtgtaatatggtgctgtccggggaagaaaagaaagagtcagttggagccagcccaacgtctgacgggtcctctactttgcaggatttcgcccgccctatcaagagtgctgcagccccgcgatatcctagacacaacggtcggttttattggtcaagaatctctaagcaattgaatttccaggtgggattgaacttttcgtcacccgacattttcttgaagtactatagcttccctagcttaaaagcgatccacaacattagtccggaccctgctgagggaaacgacctctccgtgactgattttgctttatcagtgggtgtgtcgccccggctgatcacaagtctgctccacgcaacccataaatattacaggcagttcaacatcggcaagcgaggcgggggcaagaggactatttctgccccacgcacctttcttaaggtgatacagtactggattctcgattaccttctttacacccttaagagtcatcccatttgccactcttatcagcgtggtaaatccattatcaccaatgcctctcctcatatcaatagcgaatatgtggctaacattgacattagcgacttcttcggctccattaatcaaaccatgatcattgatctcctgcgcaaaaacgggttcggcgagcagctatccaaaacaatagcaagacttacctccctgaataatgggttacctcagggagcgcccacctcgccaatactgagtaatgcctatctgtacagctttgatgaaacggcagcacagattgcccagaacacagggctgcacatcactagatacgcagatgatatcgcaatctcaggcaaaaagaaggactccattatcaacgttataactctgttcaagcaggaactgtctgccaaaggtctggagctaaacgctaagaaaacccgggtagccagtcgcggcggacaacaacgtgtagccggagtcgtcgtcaacgacaaggctctacccccgagaaaactaagaagaagggtcagggccatgttccatcaagccgacaattatcccgaggagcacgttgagaaatacaatacactgcgagggtatctgagttattttaacagctttccagcgctcaagggaggccccgagttagagagctacaaggaaatcttgaagtccttgtctaacaacgtgcagcctggcgcttga

SEQ ID NO: 14164 - RNA, 1482 nt, unidentified
  source 1..1482: mol_type = other RNA; note = synthetic construct
atgcgggttacactgaacgaaaatatactgctgtgggctgcagcagtgctgcagcctgcatctgctgccgatgtccgctcgtttattgctagcatctacccggagatcagtctgcttcctaatattggcgagattgaaaacatcttctctacctggagggaggaaggttatctccagagggttcatggcaaatcccgcctgtattctgctacctacaagaccaatctaaagctgtctgtgaaattgcgacgttcaagggacaagagcaggctgtttctattaaaatcaactcgcgcagccaacgtgaacgttagcggcgtacgggagcaagactccgtgggagattcaccaagtacagaggggtccattatactccaggagggagcctggccaatcaaaccagctgctgcccctagagttccaaggaccacagggcgtttttactggcccagaatttctaagcagcttagtatagaagtcggccctagtttttcgtctccggataccttcttcaattactacagctttcccagcataaaaaccatccacgaggcctcacataaacccgcctctgagaaggacttgtccatcacagacatctctctggcgattgggatctctcccagactgatcacctcctttatccacgctcctgaaaatcactatagacagttcaagatcggaaaaaggggcggaggtgaacgggtgataaatagtcctaggacttttttgaaggtagttcagtattggatcctcgactacctcctgcatagccttccatgtcaccccaactgccactcctatcaaaagggcaagtccattctgagtaactctctgccgcacgtgggtcagaaataccttgccaacattgatatttcgaattactttcccagcataaatgagaaaatggtgttcagcttactacgcgacaacaatttcggtgagcaactgagtaaagcagtcgctcggattgtcactttggaaaatggcctcccacagggagcccctacttcacctatcattagcaatgcctttctttgcaatttcgacgagataatgacccagcgagcactcagctttaacttggtgtatacacggtacgccgatgatatgacgatcagcggagagaataaggagaacattatctcactgatcaagaacctctcagccaatctcaaagacatggggctgtcaattaacgaaaaaaagactcgcatcgcgtcccaaggagggcagcagaaggtcacagggattgtggtgaatgaagtctcccagcccccccgaacgtatagaagaaacatccgcagtatgttccatcacgcagaaagaaaccccgagttattcgcggataacattaaggtgctgaaaggctacatcagctaccttcagtccttcccaaacatgcagggcaaaaaggagattttccggtataagaacgtatgtaagactatcgaaaagaatttcgtgcaacagtcccattga

SEQ ID NO: 14165 - RNA, 1452 nt, unidentified
  source 1..1452: mol_type = other RNA; note = synthetic construct
atgtctgcccggttcaactggcgaatcatactgtgggcgctgggagttgtgcaaccagcgactgccaaagagatacgtgagctgctgttgaaagtgtttcccgacgccggacgcatcccttctcaggatgaatttaaggtctacctcaacctctgggagaaagagcgactggttggtgtcgtgaataggaaatccgcacattattcactgacttctcgcggaaattatcgcatggggtccgacttaagatacaacagggacaaagttcggttatttctgatgaaggaagccagacggaacagaatttaccttagcggagaacagataaaggaactcgtgggggactcccctacagtaatcggcagcagggagatctacaagaggcaccggccgataattgctgcactaccctgctttggaagaaattattggccaatgctgttaggtcagctgctcgctgatcctcttaaaaacggcagccctgataaccatctcgccctgtattctttcccatcgttcgaatcccttatttcaagctacgacagattcagcagaattaaaaagccctcccttcatctgctggctctggcgataggcatcagcccccggttgattagttacatcatctataaacgccccgagcactacagacagtttgaaattgggaaaaggggcggcggaacaaggaatatctgcagtccacgagtctttctcaaaacgattcagtattggatcttggattacctgttgttcgcacttaaaatccacccctcttgcaatagttatcaaaaggggaaatccattatcaccaatgcatcagaccacgtaggaaagaactatgtggccaatatcgatataaaggacttcttcaacagcatttccgagcgtagtatttcaaagttcctgtgtaatcaggggtacgatgccggtttctctgagctgattagtaaactggtgaccctgaacgatgggctcccccaaggcgcaccaacttcccctcacatcagtaacgccttcatgtaccagtttgacgaaaagatctttaagttctgcgagaagttgaagatggtctactcccgctatgctgatgacatgaccatttcaggcagtaacaagaaagacatcataagggggatcgggttcgctaagcagtacttagactctatgggtctttcgctgaatgagtctaaaaccagaattgccagcaaaggcggccagcagaaagtcaccggaatcgtggtgaatagccacatcagcccaccgcgcatgttccgacgtaagattcgggctatgtttcataatgcctataagaaccctaaggagtacagggataagcagggccaactcaagggttacctctgttatctatgtgcatttccgggcgtgttgactgccaaggataaggagatttacgttcggacaatcaaccgcctatcatcctttgctgaatga

SEQ ID NO: 14166 - RNA, 1329 nt, unidentified
  source 1..1329: mol_type = other RNA; note = synthetic construct
atggaacccatcatctctcgttggctcgaagagagatgcatcgtaagagtgcacggtaaaagccgcctgtatagtatcagtcacgtgggtaatgacaagctgtccattcggctccgacgccaccgagataaggcaagaatctttctgcttaagtctgcacacgatgcttcatttcaggtgagcggggaagcccatcaggagcttgcaggggacagcccggctgttaacagctctgggaatacgcaggagggcacctggcccatctctagtgccagcgatcctcgggtgccaagagtcccggttcgaacttattggcctagggtcgtgcggcagctggactttaaggtgggatctgtccccaggtccccagatacacacctcacctattacagcttcccttcggttcagtccatccacgacgcctcagaacggtgtgcaccgccaaatgacctgagcatctcagacctgggcattgctttaggggtcagtcctcggcttctgactagtttcattcataaaccaagtcgccattatcgacaatttgaaattggaaaaaggggtgggggaaaccgtgttatttcttcacctaagttgtttctgaaggtaatccagtactggctgcatgactactttttgtaccgactccagattcacgattcctgccactcctaccagaagggtaagtccattctctctaatgctgagcctcacgtgggcaaacatttcgtggctaacattgatattgaaaactttttcgggtccataacaaaggacatggtatcccagttgctgaggaataatcgttttggcgagcatctgagcaattcagtggccaggctagtgaccttcaatgacgcgttaccacaaggcgcccccacctctcccacaataagtaacgccttcttatatgatttcgatgagactatggcagcctggagcataattgagggcctcacatacacgcggtacgcggacgatatgactatatcgggaaatgatagagagcagatactcgacgctatcaggctggccgagcgcctgttgaacgaaatcggactgaggcttaacagcaagaaaaccagaattgccagcaagggcggacagcagaaggtgaccggcgtcgtggttaacgagaaaccacaaccaccccgggatcttcggcgcagaatcagggctatgttccatcaagcgaaaatgtcacccgacgaattcagacaaaaactccccatgctgcgcggctatctatcctacctaagctcatatcctgccctgcgcaactctgaggagctgaactcctacatcaacgtcttgaagaaaatctcccagtga

SEQ ID NO: 14167 - RNA, 1509 nt, unidentified
  source 1..1509: mol_type = other RNA; note = synthetic construct
atgtccatccagttcaacgatcagctacttctatggggactgggagttctgcaacctgccgcccctcaggaagtattgagctttctcaaactggtctatcccacagtcgaacagtggccagacgaactgtatcttaacgaccgttttttccactgggaagagcttggctacatagtggtgctgaacaagaaatattcgatgtacagtcttacggccctggctaatatgaggatggacgtgaaactgagacggcagcgtgataaagcgagaatctccctcctgcgcgcggcatatgatgccaatgtgagtaggccgggcgtgatggaccaggacttggatggggcttcccccagttccgagatctccagcacactacaagaggggtcccgacccgtgggaagcggatctaagcctagtagaacagagccaacccggctccgcaccagaacgtattggtcccgggtcagtgagcagctctctgtgcaagtggggctggacttccactcccccggtatcccatcgtttcagtaccgatactgttcttttcccacactcaaggctgttcatcaggcaagcttgggagagagctcagaaaatgatatgagcataagcgagctgggccttgctatcggcgtgtctcccaggttactgacaagttttctccataagcctgagaatcattatcgacacttctctttgcctaaaaagggtggcggggaacgagatatcgcagccccacgcttcttcctgaagactattcagtactggattaagtcttacgtcctttgccatctgaaggttcataacacctgtcacgcatacacctcaggtaaaagcattaatacaaatgccaagccgcacgtggggaaggcttacgtagccaacgtagacatcgagaattttttcggcaatattactaaggaacacgtctttagaatcctggaaaaaaacggcgtgggccgcaaactcgcgactgcagtctcagggatagtgaccctgaatagggtcgtgccacaaggggcccctacttcccccgttatcagtaacgccgtgctgtacgaatttgataaagctatgagcaagatctccgttgataagggactcgactatagcaggtatgcagatgacataaccttctcaggcgagtcgcgctctgacattgaatacatcgtgtctaaatgccgagagttgctgtctgccgaaggattcaacctgaaggacaaaaaatcacgggttgcctcaaaatacgcgtctcagcgcgttaccggtttagtggtcaacgagaaagtgcagcctccgcgggagtaccggagaaagttacgcgccattttcaacaatgctttaattaacccacaggagtacgtcgatcgtctcgacgagctgtatggttactttggctatctcagcagcttcgatggagccaggaacgcaaggcaaattaggaaggacagaattgctatctatcgggtatccagattggctcggataaagaagtcaaaggatgagtga

SEQ ID NO: 14168 - RNA, 909 nt, unidentified
  source 1..909: mol_type = other RNA; note = synthetic construct
atgtccctcagtcagttggccctcgctatcggaatttccccacggttgctgaccagctttacccacaggccggagaatcattacagattcttcgacatctcaaagaagggcggcgggaaacggcagatagctagtcctaggttctttcttaagaccgtgcaatactggatcaagagctatatactatgccatctgaaaattcacgactcatgtcacgcatacttggtgaataaatccatcattacgaacgctgaaaagcatgcaaggaaggagtttgttgccaacatcgatatagaagacttctttggctcaatcaaaactgatcatgtcttccagttactgaagaagaacgggattggtgaaaagctgagcaaggcggtggcacacctcgtgaccctggatggaaagctgcctcaaggagcccctacaagccccacaatttccaatgcttttctgtatgagtttgacaattctctctctaagatctcgaatgaggctgggctggaatacagcagatacgccgacgatataacaatttcaggaagtagtcgctctgcaatcgagagcgtcattttcggctgccgcaatcacctctggtctaacggtctgaaattgaacgagaacaagactcgtatcgccacatcacatagttctcagagggtcactggccttgtggttaacgaaaaaatccagccacccagagagttccagcggcgcattcgcgccatctttcacatcgtaaataaaaaccccgagagctacatcgagcggatatccgaactaagggggtattataattacctgctgtccttcgatgcaattaaaaactctagacacttacagcgatatcgaatggtgatcaacaaacttaaagccgcggcccgtaataacagctcctcgcttatttga

SEQ ID NO: 14169 - RNA, 1500 nt, unidentified
  source 1..1500: mol_type = other RNA; note = synthetic construct
atgagcgtcaaattcaacaacaggttactgctgtggggtttgggcgccgtgcaacctgccactccctctgaggtgattggatttctcaaattggtgtatccagatgttaccgcatggccagataggaacttcctcaggataatctttaatgagtggcttgatcgcaactatgtgattgagctgaataaaaagtacgagatcttcagcttgaccagtgccggcaaccatgctttaggatataagctgagagtgcaccgtgataaagcaagggtgacgcttcttagagctgtatatgacgccaatctcgccagcctgggcgatgtggcccaggattcagacggcgactccccctcatcggaggctagctcagcgttgcaagaagggagtcgcccagtcaattctgggtccgagccatcaagaaccgagagtacccgactcagagcacgcatctattggcctcgcgtatctgaacagctgctgtccgtgggcttagatagacatacttcgaatattccgagctatcgatacaggtattgtagctttcctacactgcgggcaatcaagcaggcctccaatgacaattccgatacacaggatctgacaatcagccagctgggtctgtgcattggggtgagtcccaggctcctcacaagtttcgtacataaaccggagaaccactaccgaactttccgtattgggaagaaggggggtggtagtcgggagatcagctctcctcggttctttcttaagtctatccagtactggataaagagctacatactttcccagtttaacgcacacaacgcgtgccactcttatcggatcggaaaaagcatcattacaaacgcgaacgagcacgcccgaaaatcatacgtggggaacgtggatatcgaggacttctttggctccgtggacaagaagatggtcttcgaatgcttacgcaagcacgggtacggctccgaactatctcgctccattgccggcctggtcacgtttaacaattcacttccccaaggagctcccaccagccccgaaataagtaatgcaattctctttgacttcgacgaacgcctgttcgccgctgcttcggacgttggagttacctacacaaggtacgccgacgacatcactctgagtgggggttctaagcaggttgtggctcagctgattagagagtgtgaggagggcctaaaagcacatggaatgagattgaatagcaagaagactaggattgcctcaattcggagctcccaagtcgtgaccggcctggttgttaatgaaaaagtccagccatctcgagcgtatcgtaagcggatacgggccatcttccatcaggctggaatcaacccttcacagtacgtgggcaggctgaaacaattgcagggctattacagctacctctccgcttttgattctctaaaggactccaagcagctgcgggaatacagagaagtaatcagaaaactcggaatctcttcaaaagaaaaggtcgacgggtga

SEQ ID NO: 14170 - RNA, 1455 nt, unidentified
  source 1..1455: mol_type = other RNA; note = synthetic construct
atgaagaagaacgaactgcagatccttctctggagcattggcatcctgcagccagcaagtccgacactagtcagacattttctacaggaaatgctccccaaggcttttaacaatactacgacccagaaaatcaaagagaagttcagttggctccagaaaaatgggttccttgcctatgcactggacggcgtggactacatctactctctcacacgagaaggtgagttagccttggggccaggtatcaggaaaagccgcgataagatccgtttgtttctcctgagggacagtgccagctatattcaggattcaccatcgtcacccgaaaggggcttggagcttaccggcgatagccccgtggtcgaaaccagatatgtgctgcaaggccggaggcctattgctccagctgctggacctggtgtgagaagatactggccttccactttcaagcagctgaaaggatttgcgggaccgaagccccggagcgaattttatccatttgacctctactccttcgcaagtatcgatgagttgaacgcagccgtaggaactgaatgcgaccgtaattctttatccctcattcacctagctctgtccatcggcgtgtcatcgaaacttctgttcgccataagcaataactccaggcgatactatcgctccttcgagataagaaaggcttctggaggtatgagaactatccacgccccacgaatttttctgaagacgatacagcggtggatagttgactacttcctttttcaacttccctgtcaccctgggtgccattcttttcagcgtggtaaaagtattatcagcaatgcagccatacatgtcgggaagaaatacgtggggaacatagacattgccgattatttcaaaagtatcaagtctgagcacttggttcacaaactgtccaaattcttcgggattggcctgtctcgcgctattagcctcatctgcacacatgatgatttcctgcctcaaggcgctcctagctctcccattctgagtaacttctacctgttcgactttgacaaggagatctcactcctgtgtgagcaaaacgaactttcctactcacggtacgcagatgacatcacaatctcgggcaaggaaaagaacagcatttacaacgccattaattacagcaagtacctgttgaagaagcacaacctgaccctgaattatcagaagacccgcgtgtcttcacggggcggacagcaaaacgtgaccggggttgtcgtcaatcagaaaatcaatcccccgagatctttacgccggaatattagggcgttatttcacaacgcccagaaaaaccctatgcagtatacagacaagatcgagatgatgcgcggatatctctcatatctgaatatgtatgagtcccagaagaacatcatcaataaatccaggtacgagcatattattgatgcaatagccgcggtaaaagagtga

SEQ ID NO: 14171 - RNA, 1443 nt, unidentified
  source 1..1443: mol_type = other RNA; note = synthetic construct
atgtcaaacaaggtccacccgtactattacctgtgggcccttggaatcatacagcccgcaacacccacgcaggtccaacacgttctggagaagacatttgttgaaagtggggtgaagttcaatctgaacgagatagtgcagtgttttgagaattgcctgaaaggaaagattgtcttaaaagcctccgagtggaatgactccctgtttagtctggggcccaatgcctatatgttgctccctaataggctccgctttaacaaggatagaacaagactctttctgcttaaaaaggccaggatagcttcaagacgtgcctctggccacctggatttggacgcggacggggcttcaccatcagacaagcgcagtttcaagatacaggtgcctcgtcccatcaaacctctcggtctggcacccgcccagttctactggtccggtgcgtatcggcaattgaccagcaccgctggaccgaattcgacattaccagaagtgaggctcccttttttgagcttcgagtcaatcaacctcattaagtccatcaatgaatctacaaagacaactcctttctccattaccggattggccctgtgcattgggatcagcccaagccttctagtgagcaccatacgcaacattgaaaaacagtaccagacattcgaaatcgagaagcactcagggggcactaggacgattaccgctccaagagtttttctaaaaacgatccaacactggttggccgattaccttttcagcaccttacccgtgcatgacgtatgtcatgcttatcggtccaagcgatctattatttcgaacgccgagaagcatacaaatcagaagttcgtcgccaagatcgatatcagcaacttttttggcaccatcacatccgagatgcttattaagaaactgagcccattctgtagtgttgaggaggctaccgttttttctcgaattgtgacgctgaacggttccataccccagggtgcacctaccagcccttgcctgtcaaacttcatcctgttcgacgcagatgggatcatcgctaaagagtgccaaaaagtcggagtgaattacactaggtattctgatgacctgaccttcagtggagaaaaccggggccagctattagaaatcatctctttcaccgagaacgtgctgaaagagtacggctttgaacttaacccgagcaagactcatattatgacttctggcatgctgcaaaacgtcactggcgtcactgtgaatgagaaagtacagccccctagaaaggtgcggaagaaaattcgcgcaatgtttcaccaggcggagcagtccccagagaacttcaaagatcagctggaaaatctcgccggctatgtaagttacctgaatgcatacccagaactcaaagactctcagactctccggcattataaggaagtgctggtgaaattgtccaccctctga

SEQ ID NO: 14172 - RNA, 1380 nt, unidentified
  source 1..1380: mol_type = other RNA; note = synthetic construct
atgaagaccgagcttagcacacaaatttatgcgtgggcattgggaattatgcagccagcctccgcaacgatcgttaaacatttcatgcagatggctctgcccgactcttgccaggacctggagacaaaagatgtgaaggtgcagttcgctaaaatgctgaagctgggtctgatctcacagagctcagaaaagattgattacgtgtattctctgacatggcttggcaacctctctatgaacaacaaattacgtgtccatagggataaagctaggctttttcttctgaaggacgctgcacaagccgcccacaaagaacggttttcggagggcagaggtctggagttaaccggcgatagtccggtgatggacctttcctcagacaagcagtcacgcagacccatcggacaggttgtagacagtgctgacctagcatactggagcagcacctttaagcagctcaagcatagcgccggccctctacctagatcctccttttccacgagctttggcttgtactcttttgcttcgtgcaacgagttacagttggcgtgccacaacatctgtcccaatactttcgacctggatataagctctattagtctgtgtataggcatttctccaagtctgttagtgtctatgtccaacaagcccgaggatcactacagaacctatgaaatcgggaaaaagaacggggggacacggatcatccattcaccacgcatttttcttaagacagtgcagtattggatcaaggactatatcctgcattcgctcaatattcacgatagttgtcacgcttaccagaagaataaatccatacagaccaacgccagtatgcacctaaacaaaaaattcctggcgaatgtcgacattaagaatttcttcgggtctatctcccaagaaaaattgcagaacacactggccactcgttactccaagaagatgagccaatgcatctctaggctgtgtactatcaataatttgctgccacaaggagcacctacttccccggtgctctcaaatttctacctgagcgaatttgatgccaaagtcgagactttctgtcaccatctgcagctggattacacccgatatgcagacgatctcacgatttcaggtaactacaaggacaatgtgctcaaggccatagatttcgccaaagacaccctcaatctctacgaactgaagttgaacgatagcaagacccgcgttgccagcaaacacggacagcagaaggtaacaggggttgtcgtcaatgagaaaatgcagccccctcggaagtttaggaaaaaaatccgagctaccttctatcaagcaaagaagatactcgccatcattcctactcggaaaaagagttgcgaggacattctcgtgatctga

SEQ ID NO: 14173 - RNA, 1476 nt, unidentified
  source 1..1476: mol_type = other RNA; note = synthetic construct
atgacacagattcttaatgccccgagcatcattatggcgttaggggtcctacagcctgccactaccttcgaggtggtcggattcctgaagaccatgctgcctcacgccggcactctgccacaaccggatgaggttttggagttttttaaggaacgcgaggccgctggacatgtactgagagtagcccgaggcgatggtgggaccagtctgtacgcactgacgctggcagggcatagatacctgaacgtgagacagagacaggttcgggacaaactcaggttttacctgctccgtgatgctcgtcaagcccgccgacgaagttccgacggtgaggctagccgtcttgtgggagcttctcccacgttggacacctcctcacccataaaagggtctgtggcgaacaaatacggtcaccatgtgcccccaggaagaacctactggcccaggatatcaaggcagttcggagtctcgaccggcctgagcgcttcatccagcgacaccttccctgagtggctatccttccgggatcagcgccagtgcgaactggctacaaactttggcgaggggcagtttgaactggactttgagggcctggcagcatgtctgggcgttagtcctaagatcatctctcagattgcatccagcccaaataggcattatcggtcgttcgaaatcgccaagaagtctgggggttccaggacaatttcttctccccgagtgttcctgaaggtgattcagtggttcctgctcgactttatcctgactagcctgccagtacatcacgcagtgcactctttcagcttcggaagatctgtggtaaccaatgcccagacccatgagggacaggcctttgtcggctcattggacatcgaagactattttggcagtgtgactacgtccgcaatctttgagcttctagtcggctcagggttccgaaatcacgaggcccggctcatagcacgcttgagcacaaaggatgggggtcttcctcaaggagcccccactagcgccgtcttgtctaatgctgtgctgtatcccttcgatgagcaaattaataaagagtgcgcccgggccggtttaacatatacaaggtacgccgatgatatcacaatttcaggcgcggacaggagagaacttctgagggtcatggccctggcggagggccttttggctaagcacaatctccacgtcaacaaagaaaaaacccgcgtggtgagccagggcagtcaacagcgggttactggagtcgttgtgaaccaaacagctaagcctagtcggtatttcaggagattggtgcgcgccaaatttcacaacgcagctctcagtgaagaccacaacaaggttaaagtggaacagctatccgggtatctttcatacttacagatgtttccatccctcaagggctccaagctcttcgaaactctcgctcatgacttaagccgcgcacggcagaaagatccgccaatgctcatctga

SEQ ID NO: 14174 - RNA, 1125 nt, unidentified
  source 1..1125: mol_type = other RNA; note = synthetic construct
atggtgggagacgcgcctacgctcgagagtagctcatccattaaaggctgcgccgcaaataactttggtcactcagttccccgcgtgcggacttactggccgagaatctcccggcagtttgatcggtccaccggactctccgcaccatctagcgacaccttccctgaatggttatcttttcgaaataggaggcagtgcgagctggctgtgggaatagaacgcgggcagtttaagttggattacgaaggtcttgcggccagcctgggcgtgtctgtgaagattgtttcgcaagtgagccgccggccagctagacactatcgatcattcagcatccagaagaagtccgggggtgaaaggaaaatttcatcccctcgcgtgtttctgaaggtgatgcagtggttccttgatgacttcatactggatggcttaccagttcattctagtgtccattctttcgtgaccggcaaatctgtggccactaatggaaaactacacgtatgccagagttacgtgggttcaatcgatatcgagaattactttgggagtataaccaaggcaatggtccagaggctgttgctggagaacgggttcctcgacgacgaggtcagtctaatttcagccttgactaccctgaacgacacactgcctcagggagcccccacttccgctacattaagcaatgctattctgtatggcttcgactgtgatatggcaatgtcttgtgaagaggccgggcttgtctatagcagatacgcggacgatatcacaatctcaggctcttcgagagaggctgtagaacgcgccctctccagagccaaacggcaactcgctaacaggagcttcaggacaaaccccagcaaaacacggatcgtgagcgatcgtgccagacaagtcgttacgggggtggtagtgaatgctgtagcccagccatcccgcacctatcgtagaaacgttagggcaaagttccacaacgcagctaaacagaaaactcccgcaggagtcgaaattagggccctggcgggccatctcgcctacttgaagatgtttagttcccttaccggcagtcgacaaatcgcagccctggagcgtgacctgcgaaaggtccgggctaagaagcaggagtga

SEQ ID NO: 14175 - RNA, 1467 nt, unidentified
  source 1..1467: mol_type = other RNA; note = synthetic construct
atgaaaaaagttttaaacgcaaaaatggccttgctggcgctgggggtactgcaacccgcatctgctagggaagtgcgtgccttcctcaagttcgttttccctgagtccgggacactcccagacgtcgaagagtttgagcaatttctgagagaacaggagtcagtgaaccgcgtggtggaagtcgagcgtcggacaatggcctattattctctgaccctcctagggagtctgtacttaccaccagacattagaaagaagcgcgataaatttcgagcttatcttctgagggacgcccgcaggggtcggtttatcgagtcgagggagcttgggactgagctggcgggagttagccccgctagtgatacctccaccatcgtgaagggccgagccgcaaataatctgggtcggagttcatttggaagacggtttgcaaacggccaggcatactggccgcgaattcaggggcagtttattacgcgaaccggacctactaggagatccagagacacttttcctaatttgctttccttccaggatctcgatcaggctaagagggccaacggaaatgtgttctgcttcgactacagcggaataggcctgtgtctcggcctgtccccgcaacttgtgtggaatatctctcgtcgccagagctctcattacagggcctttcctgtagccaagaaggggggcggtacgcgcctcattgaatctccccgtgtcttcctcaaagtgatccagtggttcctaaacgactttgtcctgcacagactgcccgtccacgatgcggtacacagtttcagatttggacggagcattgccacaaacgcagagtgccataaacggtccatgtttgtgggcaacgtagacatcgagaatttcttcggtactattaccgaaggggctatcatctccctgctgacaaggaataacttcgcccctttggaagctatggcaattgctaaattatgccctaattggggcgccttgccacagggcgctccaactagtcctatcattagcaacgcactgctgtatgatgtggacaagaagatgtcggccgtgtgtgaggcgagaggcttggcttacacaaggtacgccgacgacatatctatttctgggccacggagacgcgacatcgctgatgcaatcagaatattcgaggccgccataagcgatttcggattgaagatcaaccaggagaaaacacggatcgcccaccggtcagggcaacagagggttaccggagtcgtggtgaatgaattcgctcagccctcccgcgcttttcgcaaacttgtcagggccaagttccatgccgcatcagtgagccccgataagggcgttcgaatgatccccgaactcggaggtatacttggctacctaaagatcttcccgtcaatgcaacagcgacgcgagattgccagctatggcgcgatcattaaatttctcaagagccagcggaccgaatga

SEQ ID NO: 14176 - RNA, 1644 nt, unidentified
  source 1..1644: mol_type = other RNA; note = synthetic construct
atgcgcactgaagaacctactgtctggccattcccgtctgtgaagagacgcaccctgctgagggccctgttgtacggtgccgcctcaggtgcagcccttggtaccttgggattgagccccagagccggagagctcgcctctgaagagatcgtgctcaccatgctcggcatcctacagcccgcttctgcggaagaggtgttctgcatattagagctgttgcatgacgcagctgccgctgagggcatggctctcgacctggaacggcctagagctggcgagatttctgaagcagttgaggccctccagcgtcagggcgcaatcttgccagtgcaggccaacccggttcgccggtattccatgactgcagctggtaatcggagactgagccctagactgcgcgctactagagacaccacccgtctgttcctgttgcacggccccagggccaggatcatggagatgagcagggaaggaagagagggggagtctggcggagcatctcctccatcaaatttgcgtagtctaatagactcactagggaggcccttaggcagcacagaggatgatggcaaccaacctccaacccgcgcatggcctgtggctagacatcggctgtggtctaggcactgtcgcacttcaccactggctctttccagggacacttcgctccgctttctgtccttcgattcgctcgaacagctgaggctggctggagggaccagcggaatggtgtcccgactgcgattgtcacctcaaggcatcgccctcagtttaggcgtgtccctgcagtttcttcgatggctccgagacacacgctacgataggcattaccggtccttcgctatcccgaagagaggggggggcaaacggtggatagagtccccacgtatttttttgaaggtgacccagaggtttgtgctccaccatatcctgagtggccagcccgtgcacgatacagttcacagttttgtccctgcagttcaggcgggagaacttaggaacagcattacaaacgctcggagacatctagccaaaccctacgtcgccaagattgacatcaaggatttctttgggagcttaagaggatacctggtcgatcaggccttccaggacacagcgctcctaaatgcggacgccaggcgtctgctgagctcactgtgcacgcggaggaatgctctgccacagggagcgcccacatcccctatgatatccaatcttattctgcggcgattcgatgaaaacatggcaagactgtgttctgagctggaccttgtatatacgcgctacgccgatgacattacaattagcggggccgtacgcgaagatgtcgagctggccgcctggtttgccagaaaagggctcaccggagagcccctgactctgccagtgaacgaagacaagagtcgtatccttagcgcaggtcaacagcagcgcgttacgggcgtgatcgtcaatgagcggggtcttcctccccgacggatgagacgcagagtacgggccatgttccaccaagccgcattagacccagcacggcttagggaagagcgagcgaggctcggggggtatctggcttatttccgggcatttcccgattatccgagtggcgagttagctcgatacgcccgcgtcctcgctcaaaaatga

SEQ ID NO: 14177 - RNA, 1500 nt, unidentified
  source 1..1500: mol_type = other RNA; note = synthetic construct
atgtcgctggctaccattcagatcggctgtaatttcccacctgagttgaatctcgataaagataaaaccactgtggtgtattggatcgcagctatcctacagccttcggataagtctacgattctgacgttcctcaaaagcatccaggatcatatttgggaaaacatctctcaggacgatataacccacagcttaaattatctctgcaagcagcagtatctcctaaagctcagcattggattgacagattacttcagtatcaatccagctaaacacatcaaacttagcatcaatgagcgacttaacaaagacaggatacgcttctttttactgaattgcggcaaggccgacaagtttcaaacagtaaggagaaactgtaaaatcaaggtcgacggagtgccaccctcttttgaagaacgacttccgatccagttgagagtcgagatccgcggtcggaggagtcaacccattatcagctcctgggttagtttgttagagtccaccctgttcacagtcagcccatccaccacacagttatcccccactcacaagtctctgtcatatcccaactacaacttcattgaccacattgacgcggatttgagcccccacatgacggttagacatatcctagctgcagatctgggtatcagtgtgcaactgatctctcggattcttgcaaacaagacccagtattacagaagttttgagatcattcggaagaatggaaataagcgcctgatcgaggcccctaggacttacctgaaggtgctgatgcgatacattaaccatcatctgctgacagggctggcgatacacgattccgtgcactcctatcgccagggcaaatcttttctgaccaatgctcagatacacgtagctaagcagtacgttttcaatctcgacatagagaactatttcggctgcattaacaaaagacaagtgagggaactcttttccataaatgactttacagcctcagccgccactctgctctcagaactgtgcactttcaacgaccgcttgccccagggtgcccctactagtccaattatctccaatgcgattctgttcaaaatcgaccagtccatgcatcgttactgtgaaaaaaacaacctctgttatactcggtactctgacgatattacactgagcggcaactcaagacagagcattgtcaaggccaagtctcgactaatcgcaatgatacatggggcagggttcaagatcaacgacaagaagacccggctgatgccttatcataagcaacagttggtgacaggagtggtagttaataaagaggcaaccccggcccggaatgaacttagacggataagggccaaatttcaccaggctgcctgctcatcacagctgccttacgctacccgttcacaacttctggggtatattagttacctcagccactttgagaaatacaggaacagcgagctccttcataagtactcccgcattatcgaaaacgtctcttttgtggcctga

SEQ ID NO: 14178 - RNA, 1458 nt, unidentified
  source 1..1458: mol_type = other RNA; note = synthetic construct
atgacagtgacactaaatagggggttcatcctgtgggcagtcggggtccttcagccagtggcttcaggagagctcttgtattacatggaacacgttttcgagaatgcgggagcgcttccctctgagaatgatcttcactcatatctcgttgaagccgccaatgtgggccaattaatccggattatgcgggagcctgatctcttcagtctgactatacaggggaacagttatttgtccagatcacagcgcatgagcagggaccgtgaaaggatattcctcctggctgacgcttggaacgggcggaagttgacctcccgggaggagcaaactaccgagtctgggggtgtgagtccacctctgctgcagcgcactaccctggaaggtacgggcgccaatgaatgcggcccgtctgttccacgcggtcgaacacactggcccagatacagtaaacagctgactaaaaccaccgggtccagctcatcatcccgtgacacctttatcaatttcctaagcttcaacgacgctacgcaggtgaaccttgcaagaagagcttctggccgcgccattcagcctgatgccgtaaacttggccctcatgatcggactaacgccacgactgattagccagattattgtgaggcccgatagacactacaggtcctttcccatcaaaaagcgtacaggcggtgcgcgcgaaatccatgcccctagagtcttccttaagaccatccagcggttcattgtcgactatatttttcatgtgctccctcaacatgacgcggtgcacagttttcggaacgatagatccatcctgtccaatgcacagtgtcacgtaggcaaacagtgggtggccgggatagatgtggaaaacttctttggaagcataaccgagcgccatatcaattctcatctgagctctatcgggcttgacgcaccctcagctaggactctggctaagctggccactttgaatggagtgctccctcagggagctccgaccagtccaatattatcgaacagcgtgctgtacaactttgatgagttgatgtcggccgaggcagagaagcaatctttagtctacacccgatatgccgacgatatcacaatttccggatcctctatcgattgtatccgcagcctgatcgcatgcgctacactcttactgaatgacatgtacggtttggtgattaacgacaaaaagaccagagtactgagccggaggagccggcaggtggttacaggagttgtcgtaaatgacgttgctctccccccacgcgacctgagacgtcgaatgagggccgcctcatataatgcaactaaagtggagggcgtcaacgtggaagccctgaacatgcttaggggctacctcggctactttcaagagtttcccgacctggtcgataataaggaatttacagatttccggaagaacctgggcaacattagggcacgattctga

SEQ ID NO: 14179 - RNA, 1470 nt, unidentified
  source 1..1470: mol_type = other RNA; note = synthetic construct
atggacagtttcatcggacatcagaccacactgtgggctatcggcgtcctacagccggtgtccgcctcagagctggtcgattattttaaggctctccttgacgacgccggcgatctgcctgatagccgcgagctccagcgtttctgccgcgatgcttctaaacgcggactcgtggtgagagtaagacggcgtcctgacctcttttccctgagcctgaagggcaatcggagactgagccgtgagcaaagactccttcgcgaccgagcgcgactgttactccttaaagagacaaagaagtcccgggtgcacgtgagccgggaagtccaagctaccgaactcgggggcgcttcaccatccgaagatgcatcttcaacaagccagggtgggagtgctaacaaaagtaggcctttagtgccaagaggattagcctgctggcccagattatcaaaggagctgctgataagacccagtcctgcctcacgagataccccccttgacctgctcagctttatgacatgggcccaggttgcaatcgcatgtggcaagacccaggaggagctgactttggattgtcattccatcggtatgatgctcggcgtcagtcctaaactgatccaacagctggcctgggatcctgagcatcactatcgcagtttcgaaattcccaagcgagccggcggtttgcggactatcgatagcccacgcgtcttcctgaaggtcattcagaggtttcttgcagactacatactggttcatctgcccatttcctccgcggtgacgtcgtaccgaattagaatgtctatccaggagaacgctcggccacacgtgggagccgaatatgtggcaaactctgacatcgaaaatttcttcgggtcaatcaaacacggtccaatcgtgaatctcttaatgcataacgggctaagggcatcttctgccaaactgattggagatctggttaccaagaaccgtagcctgcctcaaggagccccgacttctccgcccattagcaatgcgttcctttacatcttcgacgaatttatgttgtcttactgccacaccgaaaaggtgtcatacagcaggtacgccgatgacattaccatatctgggaataatcggtccgctatagaagacgccttggccatggcaaaaaccaaactactggtagagtatggcttgcgccttaatatggccaagacaagaatcgcatctaaacatgggcaacagaaagttactgggctcgtagtgaacgaaaggatttcaccaccccgcgtatatcggcgcagggtcagagctatttttcacaaggccaggctgaacaaacaggttaatgttgaggagttcaggcggttgaggggctacctcagttatttgaagtcctttgacgctctgcggcactccagtgaggtgcaggagcacgaatccactctatcgaagctgagcataaggagcacaaacgcggacacggtgtga

SEQ ID NO: 14180 - RNA, 1461 nt, unidentified
  source 1..1461: mol_type = other RNA; note = synthetic construct
atgaagacaaagctgaataccagcaacttactgtgggtgattggggtgctccaaccagtgagcgccgaggagatcacgagttacctggccactgtatttgatgatgcgggaaccatgccaaaagggaccgatattcacaagttctgtagagagcagacagacaaaaaacacctgatcagagtcgcccgcgagcctgacctcttttccctgactcttctaggaaaccagtatctgagcgacgacctgaggaaaagtcgagatcggtcccgtatttacctgcttaaagaggcctataaggctcgcctgaagatgctcaggggggtgaaggcaactggactggacggtgctgccccttccgcagatgtacgcccaagtaagaaaggccctgaggcgaacaaattgggccccgtggtgccgtcaggccaagcttattggccacgattttctaggcaattgtcagagcagactgggagtctgcccacctccagggacacaccgcttcctttcctgtcattcgccaatagagaacagctggctgtggccataagaagcaagggcgaagcaggcagcattaatttcacctcccttggactcatgctcgggattagccccaagttgattcagcagattgcacaccatcccgaccgccactatcggagcttccagctgaaaaaagcatctggtggcatgcgtaatatcgagagcccacgggtctttctcaaggttattcagcggttttttctagactacatactgtcggatctgcccgtggatgacaacgtatattcattccgaaagaactactctatcgctcataatgctgaaagacatgtgggaaagcaattcgtcgccaatatcgatataaagaacttcttcgggtccatcacaagcgaaaaaatcctcagtctcctgcgcaaacatggcgtggagcagaggtccgccgtactaatcagcgccttggtgacaaaggaaggcattcttccccagggagcagcaacctctcctttactgtcaaattccctgctgctggaatttgactcgagaatgtcacgtctagccgaaaacgcttgcgccaattactcccgctatgctgacgacgttactttttccggcaatgaccgcgatgtcatcgctaatttgataaaaacggccgaaatcgagctgttacacgattatggactccagttaaacaaagacaagaccaggatagcaacacagcggagtcagcaaaaagttactggcctcgtcgttaacgagaaagtgtggccaagtcggaagttccgacggcagatcagagctgccttcaacaacgcgcggaagcaggaggccgtcgataagaagagacttgaaaagcttgccggttacttggggtacctcaggtcttttgacgttatgaagggttcacccgatttggtcaggtactcttctatcttagcatctctgaccgtggcgcctgattga

SEQ ID NO: 14181 - RNA, 1443 nt, unidentified
  source 1..1443: mol_type = other RNA; note = synthetic construct
atgaagaatgcgcggatcaacgagagtctgcttctgtgggcggtgggggtgattcaaccagcctctccgggcgaggtaattgccttcatcgagcgcgtgacccagtctcagtttcccccaggtgtgttagagggggtaaccgcccagtgcagccactatgtggctcgcggtctgcttagggaagtgaataagcgcagaaattggtactcgcttacttacgaggctgaactccggataccgaaacggttgcgccggcgaagggacaggattagattattcttactgaaaggggcaagagccgcacgaatgagggctgtgggcgtccctcacacacagaagtctgttgacgtttcatcaacaagtagaaccagtgggggcgaagacattcaggaagtgccccgacccacgaagtcgtttggaaggggcgagcgcgctcaggaacgcttcccatggcccagaatcttcgaacagatatccgacgggagcggatctgctaccggtacaccaacacactcagatagttctaacgccaccaacccactcgcattctatacattttccggtcggcaccgcgctgctgctgataacccttatcctcttaacgtccgtgaacttggtttggccatcggcgttagtgcaaggctactgacttccatcggaaaatttcctaatcggcattaccgaaggttccagatacctaaggccaatggcacgaaccgagatatcgcgagcccccgtattttcctgaagactatccaatattggatcaaagactacctgctctaccgcttgcccgtacatgagacatgctatagctttatcagcggggtgagcatcgaggacaatgccgcctgccatgccggaaagaatttcgtcgcaaccatagatattcgggacttctttggatccattaccctcgagaacgtacagactgtgatgagaagagccgggcataccatatcattggccaggatcgttgcaaagctcgtgaccctagatggatctctcccacagggcgcccccacctcacctatcatcagcaacagctacctgttcgacttcgacagagctatgtccatgtggtgtgctaaacgtggctgttcctacactcggtacgccgatgatatcaccattagtggcgaaactcgctccgaggtccagcggtgtgtcgaccacgcagagtatcgactgaatcgttatgggctgaggctgaacgagggaaaaactcgcctgcaaagcaggggtgcaagacaggtcgtgacaggactggtggttaacgaattggcgcagccttcacgggagcaacgcagaatggtccgggcaatgctccaccgttaccaaacgggcattatgagggagcccacagatattgccagactgagaggctggatttcttactttcactcctttgaacatctgagggaaaagtttccacggatctga

SEQ ID NO: 14182 - RNA, 1434 nt, unidentified
  source 1..1434: mol_type = other RNA; note = synthetic construct
atgagccatacgaggatcaatgaatctatcctcctgtgggcaattggggtgatacagcctggttcaccggccgaggccatcgagataattgaaaaagccaccaagtcaaagctgcctcctgggtccgcggagggaattactttacagtgcgagcactatgttcagagaggcttactacgccttgtccacaagaaaaagaactggtacagtctgacgcacctcggcgacgtgtctataccaaaagtactccggaggaggcgcgaccgcattcggctttttctccttaagaatacttggcagagtcgtatcgctgacgtgggtgcacccgtcatgcaaaagtctgtggacgtgtcctcaaccatgcagaactccggggagtacgtacaggaggttccccggccaactaagagttgtaacagaggggaacggggccacgagaggtttagatggccacggatatatgagcagatgaccaagggtagtggaagcgccaatggcgctcccacacccccagtgacacctaacccgctgaccttttatacattctcgggtaaacaccggggcgaaatcgagaacccatatcctatcaatgcccgagaactgagcctggccatcgggattagcgcccggctgattacatctatcgcgaaaatccccgaaaagcattacagacgcttcaagatccccaaagccaatggatcttttcgtaatatagctagtcccaaactgttcttgaaggtgatccagtactggctcaaggactacttgttgtttagacttcctattcacgaaacctgtttttccttcatcaaaaacgtcagcattgaagataatgcttcccctcatactaagatggcatatgtgggcaccattgacatagaagattacttcggatccatcaaggtgaccgccgtccaatccgtgctgaaaagagcaggattcactgcaagcgcttcaagaatcatttcgaaactcgtcacattggatgatgctctgccccaaggagctccaacaagccccattattagcaacacgttcctgtttcgattcgacgagttcatctctaggtggtgtaagactcatgaatgcacttacaccaggtatgcagacgatgtcaccatctctggcatgaacaagagctccgttcttcagtgcatagatcgagctgagatcctactgaaccgttacgggctgaaactgaattcaaagaaaaccaggattcagtctcaaagtacacgccaggttgtaacaggcttgaccgttaacgagctcgcccaaccatcccgcgaacagaggcggaaagtgcgagccatgcttcataattaccagatcggaaagctgaacgatcctaaggagattcagcgcttacgaggctggatcagctattttagatcattcgaccacctcaaagagatttttcagatgccggcgtga

SEQ ID NO: 14183 - RNA, 1458 nt, unidentified
  source 1..1458: mol_type = other RNA; note = synthetic construct
atgagcctgccgagaataaatgagagccttctcctgtgggctgtgggcgttattcagcccacttctcccctggaaattgtgcagttcatagagtacgtgacaagggggacagtacccccaggtacactcgaagggattgagcaacagtgtcagcattatactaaacgcggattgctgcgaagtgtgtccactaggcacaactggttttcactcacgtatgcaggtgatgtaagcatccctaaggaaatgaggcggagacgcgatagaatgcgtctgtttctactgaagaaatgttggcagtcaaggatccaccatgtgggggtgccacgctcccaaaaattgattgatgttagctctatcagtcagcattccggtaaagatattcaggaggtcccccgccccacgaaatcatccaatcggggggaacgaggaagagaaaggtttcgctggcctcggatctttgagcagatcccaataggatctggttctgccattggcacacctactccgccgccacctaatacccttacattcttcacgttttctgcacagcaccggagtgaagctgcgggcaatccctatcctattaatgccaaagagttggcactgggaataggcgtgagcgccaggctgctgacaagtatcgcaaagactcccgagaagcactaccgtaagttccagattcctaaggccgacggcagccacaggaatattgctagtcctcggctttttctgaaaatccttcagtactggatcaaagactacatcctattccgtctcccaatccaccagtcctgctacagctttctccccggggtgagcattatcgacaacgccaccccccatatcgggaagaacttcgtcgccaccattgacatcgaaaacttctttgggtccatcactcagcagggcgtgcagtccctaattgtgcgggctggctataccgccgccttagctcggataatctctaagcttgcgactttggataacaccctccctcagggagctccaacctcgcccattatctctaatagttatctgttccggtttgaccaatcaatatccgcatggtgcgccagactcggatgtacatacacacgctatgctgatgacatgactatctctggaaccgacagagtgacagttaataactgcctggagagagccaccaatttactcaaccgttacggtctgaagctcaagagctccaagaccagaatacaatcacgaggcggacgacaagcagtcaccggcctggttgtaaacgagattgtccaaccacctagggaacagagacgcctgatccgatcgatgatcgataggtaccgcagggacttactggacccagcggaccttaccaaattgcggggctgggtcagttatttccagtcattccaccatctgaagaacaagtacaactacgatgagatcagcgacttggagaaggataaaatttga

SEQ ID NO: 14184 - RNA, 1560 nt, unidentified
  source 1..1560: mol_type = other RNA; note = synthetic construct
atggcaatcgcaattaatcagaacctcctgctttgggccgtcggaaccattcagccagctaacagcgatgaggtagccggtttcatttctcacgtaacccaggactctatcccagaagacattcccttcttcttcagggaccagctgagacggctggccattgaaggcctagtggttcaggtcagccaacgggagggactgttctccctcaccgaaagagggaatgaccgtctcagctctgaactgaggcggttacgtgacaggatccgactctttttactgaagaaggccaagaacgtgcggaaagcccctttgggggaccgccaacaaatgggtggcgccagcccgtccggctcagaaaagattcttcttaaggaggtggcaagacccatccgcacaaccgctcttccccacgggaggacgaactggcctcggatcggtaagcagttcttgcatcgcaacgtcgagagaagtccaagtatcccccccacaccgaccttcccggctaatcgagtacggttttactgcaccgatgggcctttcgatggaacgactagtgaggtgaactggctggcgctggcaataggaatctcgcccaggctgattactagtttcattcacaagtctgagaagcactacaggcattttcccatcgcaaagaaaaatggcggcgttcgcaatatcgatgctccacgggtgtttctgaaaaccgtccaacactggattctggactatatactggtcgatctcaactcacacgctaaatgtttctcctacaggcgagggtttagtatagaagataatgccgcaattcacagtcagcagggattcgtgtacaatattgacatcgagaactttttcggctccatatccacgtcagccgtgaatcagactttaaccaaacagggaattcctcccaaactggctaaattgttaagctacctctgtacattcaaagggtccttgccccaaggtgctccgacttccccagttattagcaacagctacctgtatgactttgatgtgttcatcgatagaatatgttaccagcttggctgcaactatagccggtacgcagacgacatcaccatctcagggaatgaattttctaaggttggagagtgcattgccgccgccgaacaacaactccgcctgttcagactgaaaataaacacagccaagcgccgtgtgcagtcaaagaacacacgacagctggtgacaggtttggtggtgaatactgatccaaaaccacctcgcacctatagaaggcagatcagagcgtttttccatcagatcaagaatgtccctaatgttgaccccaagggccagctatgcaagatgtacggctactattcctatttgtccagctttaaagctctgtctgagaacaaggagctaatcggctataggcgacagatcctggagtttaagtcaatccatttccctatcatgcatatgcactctaaagatatggaagagctcgacctttttactcagcctgcgactataacagagacagattcgttttttgaactcccagccgagccagctcctaactga

SEQ ID NO: 14185 - RNA, 1497 nt, unidentified
  source 1..1497: mol_type = other RNA; note = synthetic construct
atgactgtgagggtcaattctcaactgattatgctttcactgggcatcattcagcctgcgagcccttccgcggttgctaaatttttgagcatgtccttgctagagaattcagcccctattgaggagcagattctcatgcccttattcgagaagtggggggccgagggactgatagtgagggtgcatactaagctcaagctgttcagcctctcaagtaaaggcaaccatatccttacaaaagaaatgcggcacctacgagacaacactcggctgtttctgctcaaggaactgagagacggtactttggcacccctgggtgagcttggaaaagaagaacttacggacgcctccagcgtgtcactaatcgatctggtgatccaggaggaagagcgtccaatcaatcccgctgtgaccttgggcaaggcacagtctgacgggcgcgtttactggccgctactcgccaaacagctgttcgtcggttctataccacagtccccatctccacgatttagatacggctcgtttcagtcgttagatagctgccatatggctcatccctatggcgcccaggaaaatgatttcaatctcattgacttgtcgttgtgtatagggatttccccccgtcttctgtcctccttcctgtattccagcgagcaccattacaggctgtttgacatcgctaaaaaaaatgggggcacccgtacgatacgaagtccccgcgtaatgctcaaaacagtgcagtattggatacttgatcacctcttgcacaagctgcctatccacgatagttgcaagtcctacagaaaggggctgtctatcttcgacaacgctaaaagtcactgtgatcagaactacgttggcaacttcgacatcaagaatttttttccttccattaccaccactagactcactaaccacttcaggctgcatggatttccggagaatgcaagcaggctgatcgccaagttactgaccgtaaacaatgagctgcctcaaggcgctccaaccagccccgtcgtcagtaattcttacctcttcaaattcgatgaagtcgtgtctaacttctcaaagaaccttgagctgaattattctcgatatgcagacgatgtaacaatcagtggggccaagagatctgacattcacgcggttatcgccttttcaaccaacgagttggcccggtatgagttattacttaatcccaagaagaccaggattgctggtcggggcagccggcagatcgtgacaggactagttgtgaacaaggtggcccagccaccaagaacctaccgccgccaggtccgcgcaatgtttgataatgcaattaacaatcccgaagaattcagaagtcggctcagcgagctgtctggacacctgagctacctcggatcatttgaaaacctgcaaaactcccagagcatcgaacgctataaggagacactcaaaaaactgaggacacatctgtcagtgaacaacctgtacccgagtcctcaacaatga

SEQ ID NO: 14186 - RNA, 1464 nt, unidentified
  source 1..1464: mol_type = other RNA; note = synthetic construct
atggcagtccgccttaatcctcaggctagtttgttatctctggggatagttcagcccgccagtccagccgaggttgccaatttcatcgaacagagcttattgaaggggaagagtaaggtggacctgaacgaactaaccctgctgtttgaaagatggaagacagatgggctgatccagcgtgttcacgctcgggagaacctttattcgctaagcgccactggcaatcattctctctccaaggaaatgcgccatctcagggacaaaacgcgcctgttcttgcttaaagacctccgcaacggatcaattagactgcccgaagaagcaaagagcgagctggctgacgtgtcatcggcctctttgaatgacctcgtgtctcaggaggagcagcgacccatttctgcactcaccccgctcagaagtacccacagaagggaacccgcatactggccactcttaggcaaacaacttctggtcggctcaacagtgcggtccagtggtacccgcttccgttttgggtcattcccgagcttgaaagcctgccatgccgcccacaaaaacggggcagatggtacggattttaatatctctgatctggcgctgggaataggcatttcggccagactgctctccagtttcacacacaatgctcggaaacactaccgggagtttgagatccctaagaagacagggggtgtaaggaggatctgtgcccctagaactatgctcaaggtagtgcagtattggatcctggatcacattttatacaaactccctgtacatagcgcatgctactcctttaaggaaggcgtgtcaatctatgataacgctgtggttcatctgaagagcaactacgtgggcaattttgacattaaggactactttccttccatcaccatggacatgctgaaagacttcctgattaccaacggttatggccagatcgcaagcaacataatctcccgccttactacttttgaaggatctcttccccaaggagcgccaaccagcccactgatctctaacgcgttcttgagcggtttcgatgaagaaatctccgtgtacgtcgctgagaacggcatgcagtataccagatatgcagacgacatcactatatcaggcgctgataggggcaagatactatccgccattgagttcgccacggagaagctgaaagatcttaatttcctgctgaacgagaagaaaacacggatcgctggaagggcctcccggcaagttgtgactggactggtcgtgaacgaaattgtccaacctacacgttcctaccggcgacaggtgcgagcaatgttccaccatgctagtaagtaccccgaggagtttcaggccaggacaaaacagctgggagggcacctcgcctatttgatgtcatttgagaatatccgagagactgcggctattagcgagtacaaaaggattctagtctctattaccaatccaagcccatga

SEQ ID NO: 14187 - RNA, 1500 nt, unidentified
  source 1..1500: mol_type = other RNA; note = synthetic construct
atggaggagtctactaattataagctgcttgtttggggactgtccgtcattcagcctgccactcccaacgaagtcttaaactatttgactagcacgctcaacgacaatggcttgttgcctgatgtggaaaaaatgattcactacttcgagctgttagaccaactggggtacattcatcaagtgtctaaacgcaataacctctatagtctcaccccaagaggtaacgaacggttgacccccgcacttaaacgcctgagggacaaaattaggctcttcatgctggacaattgtcattctattagcaaacttggggtactagcatccactgatacagaaaatatggggggcgatagccctagcctacagctgaggcacaacctcaaggaagttcctcatccatcactgtcctgggcagctggcaccctgccaagttcaccccgacaagcctgggttaggatctatgagcagttgaacattgggtcgatgagctccgacgaagccagtacaccaaccacggctcggaatgccccgctgtcttttgtaggtagacttggattttccctaaactactactcctttaacaagatcgacgagccactcttcaataatgacggcgtgaccgccatagcatcctgtataggaatcagccccggcctgatcaccgctatggtgaaatctcctaagagatattatcgcaccttcaatttgcgcaaaaaaagtggcggcttccgtagcattctggctcccaggaagttcataaaaaccatacagtattggctgaaggatcatgtccttaatcgtctgaagattcactcatcatgctactcgtacagatcgggagtaagtatcaaggacaatgctatcaaccacgtgaaaaagaagtttgtcgccagtatcgacatcagtgattactttggttccataaacaagaagatggtcaaggactgcttctataagaataacatcccagatcacatcgttaataccatcagcgggatcgtgacatataacgatgtgctgccccaaggtgccccgactagccctataatttcaaacgccattctgttcgaatttgatgaggagatgacagctcacgcacttactctcgattgtatatacacacgatactcagacgacatttctattagcagcgattacaaagagaacatcgcgattttgatcaacatcgccgaagctaacctgctatccgcagggtttaccctgaatagacagaaacagaggatcgcgagcgataattccagacaggtggtgacaggcattctggtgaatgagtctatccgacccactcggtgctatcggaaaaaaattcgctctgccttcgaccatgccctgaaggagcaggatggatcccagctcacaatcaataagctgcggggatatctcaactaccttaagtctttcgagacgtacggctttaagttcaacgagaagaagtacaaagaaacactcgactttttaatcgcgttaaagcagtcatga

SEQ ID NO: 14188 - RNA, 1062 nt, unidentified
  source 1..1062: mol_type = other RNA; note = synthetic construct
cgccaggcatgggtccgaatttatgaacaactaaacatcggcagtatgtcatcagatgaggcatctaccccaacaaccgctcggaatgcgcccctgtcctttgttggccgactcggattctccctaaactattatagcttcaacaagatcgatgagcccctgttcaataacgacggagttactgctatcgcatcctgcattggcatctcgccggggctcatcacagccatggtcaaaagtcccaagaggtactaccgcacatttaacttaagaaaaaagagcggaggtttcaggcctatcctggctccccggaaattcattaagaccattcagtattggttgaaggaccacgtgctgaacaggcttaagatccattccagctgctatagttatcggagcggggtgagcattaaagataatgctatcaaccacgtgaagaaaaaatttgtggcctcaatcgatatcagcgattacttcggcagcataaataagaagatggtgaaagactgcttctataagaacaacatacctgaccacatagtaaacactatatccggtatcgtgacgtacaacgacgtacttccacaaggggcccctacttctccaattatatctaatgccattctcttcgagtttgacgaagaaatgaccgctcatgcactgacactcgactgtatttacactagatactccgacgatattagcatctcctctgattacaaggagaatattgccatccttatcaatatcgccgaaaccaatctgctgtcggccggatttacattgaatcggcagaaacagcgcatcgcatctgataattcacgccaggtggttactgggattctggtcaacgagtcaattaggcctaccagatgttaccgtaaaaaaataagaagtgccttcgaccatgcgctgaaggagcaggatggcagtcaactgaccattaataaactccgtggttacttgaattacttgaaatcctttgagacgtatggcttcaagtttaacgaaaagaagtacaaggagacattagactttctgatcacccttaagcagtcttga

SEQ ID NO: 14189 - RNA, 1500 nt, unidentified
  source 1..1500: mol_type = other RNA; note = synthetic construct
atggaagagagtacgaattacaagctgctgttatggggtctgtccgtgatccagcccgccacaccgaatgaagtcctcaactatctaacttctacgctgaatgacaatgggctcctgcctgaggtggagcgaatggttcactactttgaactcctggagcaacacgggtatatgcatcaagtcagtagacgcaacaatttgtattcactcactccccgcgggaacgagcgactgactccaaccctgaaaagactgagggataagatccggctctttatgctcgacaactgtcacagtatctctaaactgggcatgttggcatcaaccgacaccgaaaatatggatggagactcaccatccctccaacttagacataatagcaaggaggtgccccatccttcgcttccctgggctgctggtgcacttccgtcttctcctaggcaggcttgggtgcggatctacgaacagttaaagattggctctatgtctagcaacgaagcctccacaccaccaaaacggaaaatcagtagcttaccttccattggacggctgggattctctcttaactattacagcttcaatacactcgacgatcatttgtttaacaacgatggggtgacagctatcgccagctgtataggcatttctcctgggctgcttaccacaatgatcaaatcacctaagagatattaccgtactttcaatctgcagaaaaaatccggaggctttcgtccaatcctggcaccccgcaaattcattaagactattcagtactggatcaacgaccacgtgctgaacagactgaagattcactcttcctgctacagctaccggaagggcgtttccgtgaaggacaatgccatcaatcacgttggcaaagcctttgtagcatctatagatatttcggactatttcggttccattaataccaagatgatcaagtcatgcttctacaaaaacaatatcccagagcacgtcatcaacgctatcagcgggatagtaacatacaacgatgttttgcctcagggagcccccaccagcccgataatcagcaatgcgattctttttgaattcgatgccgagatgacttatttagccttgagacacaacagcatatatacgaggtattccgacgacattagcatttcgagtgacaaaaaagaaaacatcgatgagctgatccgcgtagctgaggccaatttgctttccgtcggatttaaactgaacgagaacaaaaggcgcgtcgtgtcaagaaacaataggcaggtggtgaccggcatattggtgaatgaaagcattaggcccactcgtacatatcgaaagaagattcgcagtgcgttcgaccatgcattgaaggagaatgataataaccagctaaccattaacaagctgaggggttacctcaactatctaaagtcctttgaatcatacggctttagtttcaacgagaagaagtacaaggatatcctggatttcctcctgaccctccaacagcggtga

SEQ ID NO: 14190 - RNA, 2154 nt, unidentified
  source 1..2154: mol_type = other RNA; note = synthetic construct
atgcctggcaataaaggcgaacttatcaatatacggaacaaaggggatgggaatacgtttaacatcatccaaataaacggtggtaatgcgcccgatatatccaagcagctcggcttcctgggtctagacataatcgataatacgaaaaagtcactggtaagcgaattctcttcgggcaacaataacgtcttgctctgttatccaaataaggaagataagattctcgagcccataatcgagaaaatcaaagcgggactcagtaatattggagcaaatatctttgagggatcgggcaagacccagctcccagacgttcagggttatccccatattgctgagatcgatttcatcaagaatctgaagtgcgattcaatcatcattttcgtgctggacgagctgacactatctcaactcacactgttgagctactacaaaattgagagcaacatacagcatgttgacatcattgcaatacctagcgactcaattttcaactacgacaaattcctttccaacgggctgattcagtattgcgacgataataactgcaaagtgattaagctttccacactggatgatgctgaagtggaaagggtgattgccagggttaaaaataggaagatgatccaggcccgccggggcattatgctgactaaagccgacgcctatgactttaaccacaaactgtttatatgggcactgtcggtcattcaaccagcaagcccttacgaagtgatttcctatctgtctatcatactaaatgacaatggcgtgttgccggccaaggacaaaatcaacgagtactttaaagcactagctagttctgagtacattaatcaggtcagtaagaagaacaatctgtatagtatctctcttaacggtaacgaacagctcagccctgagctgaagaagctgcgcgataagctgcggatatatttgttagataagaccagggtggtatctaaagtcaaggtgttggcatcaacagaatccaaaaagatggggggagccagcccgtctagtcagcttcgcttcgtcctcaaggatgcaccacatccctcagtgccttgggcgcttggagcattacctaatcatccacgcaatacttgggtgcggatcgccgagcagattaacttcggatccatgttgtcagaggccagtaatactgaaacacacgtgaaccagacgcagcataccatctttcccctgaattatggcagctacaacagtatcgattacaacttaattggaaacacaggtccaaccattctggcttccctgatcggcgtctccccccacttaatcgccattatgagcatgaatcctgacaagtattatagaagcttcaagctgaacaaaaagtccggaggccacagagagatactggctccacgtaagttcatgaaggtaattcagtactggattaccgactatttcctctttcgactgaaaatccatgccagctgttactcttataggaaaggcgtcagtatcaaagataacgctattaaccacctgaacaacgagtttatcgcaaatattgacgtaatcgatttctttgggactatcaataaggatatggttcaaaagtgtctcattaagaacaaaatcgacatcaaactcgctaccgccatcaccgaaatcgtgacctttaaggggtttctaccccaaggcgctcctagctccccccagatctcaaatgccatcctgtttgactttgacaacaaaatctctgaagcttgctacgtgataggctgtgtgtatacaaggtacgcggatgacatcaccatatctgggtctaaccgtaacaatgttattaagatggtgaaatccgccatgcagtggttgaatgagtccggattctctgtgaatgacaagaaaactagaattagctccaaaaacagtcgccagatcgttactggaatactcgtcaatgacgttattagaccgactcgaaaataccgaaagagagtcagagccgctttcgaccacgcccttaaagacaatgatcactcaaaggagacaatttacaagcttagcgggcacctgaactacttaaaatcattccaacagtatgggtacgaggtgaacaccattcagtacgaactcatcttgaagtacttgaagcggaagaacatcctgatcaagatttga

SEQ ID NO: 14191 - RNA, 1497 nt, unidentified
  source 1..1497: mol_type = other RNA; note = synthetic construct
atggaggtgaacacaaattttcgcctccttctatggggcgtgtcaattatccagccaagttcccctgacgaagtgctcggctacctgaaggctgtcttgaacgacgacggtctgctacctgaaattgaagtcatggaggactacttcgataagcttaagaaaatcggttatatcgaacaggtttctaaacgcaataacttattctccatcaccccccaagggaatgaaaagctgccacctcgcttgaagaaactgcgagacaaaatcagaattttcctgctcgataagtgctatatccagagcaaacttgagcgtctggcctcgactgagactgagaaaatgtccggtgatagcccattcctcaccctgagacacattttgaaagaagtcccacaccctagtctcccgtgggcgacaggaactcttcctagtagaccgagacaggcctgggttcgaatttacgaacagctgaagatcggctcgaccttcggagacgaggcgagcacatctatcacagacacctctccctcagaagtgaagaagaatattctgtctctcaacttctactcctttaataacctcgagcacaattactttaacaacaacggggtgacaatcatttcctcctgtattggggtatctcccgggttattaaccagtatgattaagtcaccagagaaatattaccggccctttgagcttaccaagaaaaacggcaaaaaaagggaaattctggcacccaggaagtttatcaaggtcactcagtactggatcgcagaccatctgttgaaccgcttgaagatacattcctcatgcttctcctacaggaaaggtgtgggcattaaggacaacgcctataatcatgtcggcatgaagtttgttgccaatattgatattacggattacttcggcacgatcaacaagaccatgattaagaaatgtctcctggacaataagatcccaataagtattgttgaggtgatatccgggcttatcacatattatggatacctgccgcagggagctcctactagccccataatcagcaatgccatcttacatgatttcgatgagtctatgtgcgaatcagccctgcacttcgactgtgtatacacccgctattctgatgatatcaccgtaagcgggaattctagggagaaagtctttcttctgacgcgggtggcagccaaactgctggagagaaggggatttagtataaacgaagagaagacacggattctgagcaccaacaatagacaggtggtgaccggcatcctagtgaatgaaagcctccggcccactcggaaatatcgtcgaaacgtgagggcagcttttgaccaagctataaaaactatggatacaagcgacgatactttgaattcactgaagggacacctgaattatttgaacagctttaagcaatacggcttcaaattcgaccacgagaagtatcagctcatcatcaatgagctgatcaagaacaaggatataaactga

SEQ ID NO: 14192 - RNA, 1461 nt, unidentified
  source 1..1461: mol_type = other RNA; note = synthetic construct
atgttgttatgggctaactccattattcagcccgcatccccattcgagatatctcagtacctgaagatcatactggccgacgatggtgcgctgcccgatctggaatacctcaagcagtatttcaaagaattgcagaagaacgggtacgtggaggtggtaagcattaagaatgaactgtactcactgacccccgctggtgaagacaaactctcagccaaccttaaaaagttgcgggataagttacgtatcttcctgttagacaaatgcagggagtcctccaagttggagacactcgcaagcacagagacgaagaatatgggaggggagcccccatctcttcaacttcgcccctatatcaaggaagtgcctcatccatccctgagttgggccagtggcacactgccttcccgtcctaggcaggcttgggttagaattttcgaacagctgcgcattggctcaatgtcaagttctcaagcctccgcatttagcaagaatactggcctgtttactccagagaaaaagtatgtcgcagctcccctcttctattcatttaaaagcctcaacaacccgctcttcgataacaatggggtcctcacaattgcgtcctgtctggggctcacacctcgacttatatcttccatgattaaaagcccagaacgctactataggtttttcgagatgaagaaaaacaacggaggagtcagaaagattagtgccccgaggaagtttctgaaagtaacacaatactggatcaacgactatttccttaacaggctaaagatccacagttcctgcttctcttaccgcaaaggggtgagcatccgggacaatgcctaccctcatcagaattcaaagttcgtggctaacattgatatcgagaattactttggcagcataaataaaacgatgatcaaagggtgtctgctaaggaacaatatctcggaacaccttgttaatactatcgccggtttaaccactctgtttggaactctgcctcagggcgcaccgaccagcccaaatattagcaatgccattttgcacgactttgatgagataatgaccggccacgccatcgtgcgaagatgcgtctatacgcggtattcggatgacataactatctctggcaatgaaaagcacctggtcgaggagctcgtgggtctagctggaaacaaaatcaacgctattggattcgccctcaacaattctaaatatcgccttttgtcttacaacaaccgacagaccgtgacagggatcctcattaatggccatctgcggcccacccggaagtacagaagaaaagttcgggcgatctttgaccaagcactgaagagtaatgacagaaatcctctgaccctgagcaccttaatgggacacctgaactacctacagtcatttaagaaatatggctttcgtttcgaagaggagaaatacctgttcatcatccataagttgaagaactga

SEQ ID NO: 14193 - RNA, 1485 nt, unidentified
  source 1..1485: mol_type = other RNA; note = synthetic construct
atgtcgaactctattaatttcagactcctactgtgggcaaatagcatcatccaacccgcatcgccactcgaaaccctgaattatctgaaactcctcctagccgacggcgagactctgcccgacatcgaatccatccggctctacttccgtgaactgcagaagattggttatttagaggtggtcagcatcaaaaacgagctgtattctgtgactcccgccggggaagataaattaactgccaatcttaagaagctgcgcgacaagttgaggatatttctgctagacaagtgtcatgaatccaccaagctggaaaccctcgcttcaactgacacaaagaacatgggtggagagagcccctctctgcagctcagaccatatataaaagaagtgccacacccaagcctgagttgggcaagtggtactcttccttctaggcctaggcaggcttgggttcggatctttgaacagctgaggattggatccatgtcaagcagcaaggcctcaagcttcagtaacagtattgagtttctcaatacagagaagaaacacatagcagcgccgctcttttactcctataagagcctgaacaatcctctgttcgaaaacaatgggattctgaccattgcttcatgcttgggcctgaccccgaggcttatctcctccatgattaaaaaccctgagaagtactacagattttacgagatgaacaagaaaaacggaggggttagaaagatttctgccccccggaaattcttaaaagtaacacagtactggatcaacgattactttttgaatcgcctgaagatacactcttcttgtttctcctatcggaaaggcgtgtcgattcatgacaatgcctacccgcaccaggattctaaattcatagccaacatcgatatcgagaactactttgattccattaacaagaccatgatcaaaaactgcttactgcgctgcaacatctccgagaatcttgtcaacgctatcagtggcttgacaaccctctatgggactttgcctcagggggctccaacaagcccaagtatcagtaacgctattttgcacgattttgacgaggcaatgacgaaccaagcactcgtgcgcaattgtgtctatacccgatatagcgacgacatcacaatctctggaaataagcggtacctagtcgaggagttggttggtttagcccgaaacaaaatcaacaacctggggttcacgctgaataattcaaagtacagactgcttagctataataatcgacaggcggtgaccggcatacttgtaaacggccctctccgccccacacgtgcctataggcggaaggtgcgtgccattttcgatcaagctcttaagagcaatgatagaaatcccctcactctgtcaacgttgaaaggacatttcaattacctgaaatccttcaagaagttcggcttttcttttgaggaagataaatacctgtccattcttgacaaactgtcaaagtga

SEQ ID NO: 14194 - RNA, 1488 nt, unidentified
  source 1..1488: mol_type = other RNA; note = synthetic construct
atgtcaaacagcatcaactttagactgctcttgtgggccaccagcatcattcaacctgccgcgccgtcagaaatcctgtattatttgcgactcatcctgacagatgatggggcactgccaaatatcgatagcttaaagcagcacctaaaagagctgcacaagattggatacgtcgaactcgtgtctattaaaaacgagttgtactcgataaccccatctggagacgagaaactgagcgcaaatctaaagaagctgcgggataagctgagaatcttccttctggacaaatgtcataaaagtacaaagcttggggtattggcctccaccgatactaaaaacatggacggtgctcccccttctctccagttacgcccctatattaaggaggtgccgcacccttccctgtcatgggcttccggaaccttaccaagcagacctcgtcaagcatgggttagaatttttgagcagctccgcattggttccatgtcaagcagccaagctagtatcctgtccaaggacagtgactctctcatcccagaaaagaaaatcatcgcagctcctatcttctactcgtacaagtccctgaatagccctttgttcgaaaacaatggaattctaacagtggcgtcatgtattggtttgacccccaggcttataagctctatgatcaaaaatcccgatcgctattatcggatctttgacatgaggaagaagtccggcggggtacgcaagatcagtgctccccgcaaatttatgaaggtcactcagtactggataaacgattacttcctgaacaggctgaatatccactcctcttgcttctcttaccgaaagggaatttccatacacgacaacgcctacccacatcagaacaacaagtttattgccaacatcgacattgagaactattttggctcgatcaacaaaacgatgattaagaattgcctgcttcggaacaacatcagcgaacatatcgttaataccatagcagggctcacaacactctacggcacacttccacagggggccccaacttcccccaacatcagtaacgctattctgttcgaatttgatgagttaatgaccaatcaggccctggtgcgggactgcgtttacactagatatagcgatgacattactatctctggcgacaatcggcacctcattgaggaattagtctcactggcgaagaacaaaataaattctatgggctttacgctgaataacgcaaagtatcgtctattgagctacaataataggcaggccgtgacaggcatactgattaacggtcctctgcgaccccccagggcctatagaaggcgggtgcgtgctattttcgatcaagccatcaaatctaatgaccagaccagtcttacgattaatgccctgaaaggacatctcaattacctgcagagtttcaagaagtatggcttctccttcgaagagactaaatactcacttatcatagagaagctcaccaaaaaatga

SEQ ID NO: 14195 - RNA, 1494 nt, unidentified
  source 1..1494: mol_type = other RNA; note = synthetic construct
atgagcaattccatcaatttcagattgctgctctgggctacctctattattcagccagctacatccgcagaaattctctactacctgaagttagtgcttgcagatgatggagccttaccggacgtggaaagcttaaagcagcacctgaaggaactgaaaaagcacggttacgtcgagatcgtgtcggttaaaaaggagctttactctctaacaccggcgggggatgagaagctgagtgcaaatctaagacaactgcgggataaactgcgaatttttctcctcgataagtgttacaagtcaaccaagtttgggctgctcgcctcaaccgacacaaaaaatactgggggtgaatcccccagcctgcaactccgtccttatatcaaagaggtgcctcatccatcactcccttgggcaagcggcacattgccttccagaccacggcaggcttgggtaagaatttttgagcagctgagaataggcagtatgagcagtagtcaagcctctacgttgtcagaggactcgaataatcataattttggcgactcctttgtcgcagcgccgaccttctatagctacaagtctctgaaccaccccgcctttgaaaataacggggtgctgaccatcgccagctgcattggtctgacaccacggctgatcagttccatgatcaaaaatcccgagcgctactatagggtatttgagatccccaaaaagagcggaggggcccgcaaaatatcagctccccggaaattcatgaaagtgactcagtattggatcaacgattaccttctgaacagactcaagatacattcatcctgtttttcttatcggaaaggtacatctatacacgacaacgcctatcagcatcggaacaacgacttcattgccaacatagatattgagaattacttcgggtccatcaataaaactatgatcaagaactgcctactgaggaacaatctttccgagcacatcgtgaacaccatcgctgggttgaccaccttgtacggaactttaccccaaggcgccccaaccagccccaatatcagcaacgccattctgtatgatttcgacgaaactatggctaaccaggcaaaggctcgcggctgtgtctatacgaggtatagtgacgacattacaatttccggaaacgaccgctactctgttgaggaactagtgggaattgccaagaacaagatcttctcactgggcttcaaaatcaacgaaagtaagtaccgattgctgtcttacaataatcgccagctggtcacgggaatcttaataaacggccctctcaggccacctaggctgtaccgaaagaaggttagggctatcttcgatcaggcgctgaagtccaacgattgccgtacttctacacttaacaccctgaagggccaccttaattatcttttgagcttcaaggtctatggcttcgagtttgacgaggaaaaataccagctcattatcgacaaactcactaaagaagtgcattga

SEQ ID NO: 14196 - RNA, 1488 nt, unidentified
  source 1..1488: mol_type = other RNA; note = synthetic construct
atgactatctctataaattttaggctgctgttgtgggctaccagtataattcagcccgccaatgccaacgagatcctgagctacctcaaactagtgcttaaggacgacgacgctttgcccgatgaggcatccattaagaaatacctgaaggaattaagagagattggatacctggagctcaccagcgtcaaaggagaactgtattccattactccgattggcgacgagaagctgactgccaatctgagacagctgagagataaactacggattttcatgcttgataagtgctacaagtactcgaaactgatgttacttgcctccaccgacacgaagaacatggggggagattctccctccctgcagttacgtcatgacctgaaagaagtccctcatcctgggctgtcttgggcctcaggcactctgcctagccgaccacgccaagcttgggttcgaatatttgaacagctccagattggttctatgagctcttctcaggcgtccaatcttaaggacgatagccagaatcctccttccagcttcagttttacccctgccccgactttctacagctataagagtctgaacaatcccctgttcgaggagaatggggtactgaccatagcatcttgcctcggattgacgcccagactcatcagctctatgatcaaaaaccaggagaagtactatcgcgagtttgacctctctaaaaaaagtggtggcatcaggaagatcagcgcaccacgcaaatttatgaaggtgacacagtactggctgaatgactacctgcttaataggctcaaggtgcactcagcatgttttagctaccgcaaaggcgtgtcaatccatgataacgcactccaacacgtggataaaaaatttgtggccaacattgatatcgagaactatttcggaagtatcaacaagactatgatcaagtcctgcctgcttcggaataatttttccgagcacctggtgaacacaattgctggtttgaccactctatatgggacactaccacaaggcgcgccaacaagtccaaatatttcgaatgctatactctacgagttcgaccaaacaatggctaatcaggcgatggtccgcaagtgtgtatatacaaggtattccgacgatatcaccatctcaggagatagcaaaagcgccgttaaggaattaatcaacctggcacgtctcaagatctcatccctcggcttcaaccttaacgaccacaaattccggctgttatcatataacaatcggcagcttgttacaggcgtgttgatcaacggggctctgaggcccccaaggaaatatcgaagaaaggtccgggccattttcgacaaagccttgaagaccaacgataccagtctgctgaccataaatacgttgaagggccacttcaactatctctcaacctttaaagaatacgggtttaagttcgaagaagaaaagtacttgtccatcattaactatctccagaagaagtga

SEQ ID NO: 14197 - RNA, 1434 nt, unidentified
  source 1..1434: mol_type = other RNA; note = synthetic construct
atggctaacctggtcaatttaaagacctatctgtgggccttggcaactattcagcctgcctcaccccaggaagctcacgctttcctgaaaattgtcaccaatattgagccagacatttacacagaggaggacctcaacgatgcaataaatcggtccatgaaactggagctgattgaatgtgtgtccaagaagcacaacatttatacgctgactattaagggcggagacttcctcggaaagaaactacgactcctacgcgataaaaatcggctgtttttgctgaaaaccgtgaaggatgcgtcactcaaaatcaaggatagcccggagcaaaacaaagctagtgtaagctcagctacaatgtttaggagtaccgtgaaagtagccccttggccagaaaactctctggtcagcggtccgttgccccagaaccagagagttttttggccccgtgtgtctgaacagctgagaatcggatccaatgcgggcgggtcattcctcaatctgaactactactctaagaacaagctccctaacataaacgacgacttcagcgccgtcgatcttttcagcgaactgattgggatttcgcccaggctgttatcttccttcatcaaagcccctagtaggcactataggacgtttaccctgcagaaaaagagtggccgaggtcacaggacaataaattccccacgcgttttcatcaaaactgtgcagtattggatatgtgactatttcttgtacaagctcaatcagcatgagctttgctttagctttaggaagaacctgagcatcaaagacaatgcccgaatacacctggggtcccgctacatcctgtgccttgacatcgactccttcttcgacaacatcaagacagaacatgtgcattcgtgtctgattgagaatgggttctcagaggatattagcagttttatcagccgggtggttactttagatggctgccttcctcaaggggctcccactagccctatcatctctaacagttacttgtacaactttgacaaggtgatctctgatttttgcggtcagaatggaatgacatattcaagatacgccgatgacttaaccataggcagtacggattacactcagctcaaatcctgtattcccttgatcagcaagcaactggcaaagtttgaacttaaaattaacgagcgcaagaccagaatcatatccaataataacgcccaaattgttacaggcgtgtgcatcaataacgagagactacggccatctcgtaaattcaagaaagaagtccgggccgcatttaacaatgccaagcttaacaacgataagtcttcgcttccacgcctctatggctacctcaattacctgtcctctttcgataatggagacaccccacataatatctccgagtataagagcatcattgactcaatcaaaaaggcattgtga

SEQ ID NO: 14198 - RNA, 1434 nt, unidentified
  source 1..1434: mol_type = other RNA; note = synthetic construct
atggcaagtctggttaatctcaaaacttatctttggagccttgctactatccaacccgcctcacccgaggaagctcacgccttcttgaaacttgtgacaaaggtcgagagcgatatctacacttgtgaggatctcaacgaggcaattctaagggcaatcaagctgaacttaatagaatgcgtgagcaagaagcataacctctactctctaacggttaaaggcggagactttctgggcaaaacactgaggttgctccgtgataagaatcggttgttcctgctgaaaagcgtgcgagacgccaacttaaaaattaaagaatcccccgagcaaaacatggtcagcgcttcttccaccatcacctttcgttctactctgaaagtagctccatggcctgaaaactcactcgtgtcaggccccttaccgcagaaccagcgggtattctggccccgggtgtctgaacaactaaagatcggcagcaacagtggtgacagcttcctgaaacttaattactactctaagaaccgcctgcctgagatcaatgaaaatttttcccctgtggatctactgtctgagctcatcggaatatcaccgagattattgagctcttttattaaggcacctagtaatcactatcgcaccttcactatcgaaaagaaatccggacgagggcatcggaagattagttcccccagggtgtttatcaaaaccgttcagtattggatttacgactactttttgtacaagctgaatcagcatgagtgctgttttagcttcagaaagaacctcagtattaaggataatgccaaagtccacctgggcaagaagtacattctgtgtttggacatagactcttttttcgacaatatcaagaccgcagacgtcaacagctgcctgattagaaatggcattccatccgacattagtagtatcatctcaggaatagtgactctgaacgggtcactccctcagggtgccccaacaagcccaattatctccaatgcttatctgtatgagttcgatcagaagatgtatgaattttgcgttaggaacgggatgacatactcacgctatgctgatgatctcaccatcgggagtaccgattatacgcaactgaaatcttgcataatctttatttccgagcagcttacaaagctggagctcacaataaacgagcgcaagacccggattatttcaaataacaatgcccaggtcatcaccggtgtgtgtatcaataatgagcagctgcgcccatcgaggaaattcagaaaggaagtgcgagcggccttccacaacgcgaagcttaacaatgacaaaggctccctgccaagactgtacggataccttaactatttgagctccttcgactccggggatacacctcacaacatatctgaatacaagtcgatcattgacaggatcaaaaaagccctctga

SEQ ID NO: 14199 - RNA, 1452 nt, unidentified
  source 1..1452: mol_type = other RNA; note = synthetic construct
atggctaatctcgtgaatctgaaaacatatctctgggccttagggacaattcagccagcctctgctaacgaagcacatcaatttatcaagctgatgaccaacgtgacctcagatgtttattccgagtccgacctggatgacgctattaaaaggagcctcagcttgggatatattgagaatgttagcaagaagaacgagctttacattttaacggcaaaggggggagaatttcttgggaagaatcttcgactgctccgggataagaaccgcctattcctgctgaaaagcatccggagtgccaccttccagtcgaaagactccccggagcaagacgtggctggtgtcagtccccctaaggtattcagaagcagtctcaaggccgctccttggccagagaattccctttcacccggtgcactgccgcaaacacagagggttttttggccacgggtgagcgagcagctgcagattggatcaatctccggcgaatctttgccctccattaagctcaatttctactcaaagaacaagctttcagatatcaacgacaatacaactgcaatcgatgccttaagtgaatctatcggcatctctccacgactactgtcctctttcattaaagctccttcaagccattaccgcactttctcgctgcagaaaaaatcatcaagtggcacccggatcataaactctcctagggccttcatcaaaactgtccagtactggctgcacgattactttctttttcgcttgaagctgcacgactgctgcttcagctttcgtcaaaaagtgtccatcaaagataacgcaaaggtacacctcaactccaattttatcttgtgtttggatatcgaatccttctttgacaatatcacgacagagaacgtctatagctgccttgtgcgaaataagattgacgaaaacattgcaagcgttatagcggggattacgacactcgataactccctgcctcagggtgcgccaacctctcctattatctctaacgcctacctgtacgactttgatcagtctatgctagagttgtgtgccaagaataaaatgacttattccaggtatgctgacgacctgacctttggcagcaatgactatatgagtctgaaggatctgatccccactatcgccgagtctctccggagttatagactccgcataaacaagaagaagaccagaatcatatcgagcaataattcacaagtcataaccggggtgagtattaacaatggcgtgctgaggccctctagaaaactacgtaaagagattagagtcgcgttctatcaggccaaaactaacaagaacgtggacgccctgcccaaattgtacggatacattaattacctcaagagcttcgaggacggagacacagattacaacttagaactgtaccagggcaccatagatgaactgaagggcatcaccaaacagagccgctga

SEQ ID NO: 14200 - RNA, 1482 nt, unidentified
  source 1..1482: mol_type = other RNA; note = synthetic construct
atgctcggggaaaatagtatgagttccgagttgaacctgaaggcctttatatggggtctgggagtgattcagcccgccactccagaagaagtccagaattttatcctccaggttttgctgaaacagtcaaacaaagagtttgacatgcagatcaccgctcagaagttgctggacgaggactatatccgatgcgtcagcaaaaagaacaagctgtactctatcacacatgagggtgacgagtttttagggaataagctcagagctctgaaggataaagagcgattgtatctcctgaaaagtactcgcgacgtgaatttctcagggaaaggcgcgagcgagaggaatagcggtggagcctcccctttgaaacaggcctcctctagtacaaaggtgagtcctaggcccgaaataagccttagccctggcccccaaccccagattcaacgcaacctttggcctcgtgtttacttgcaacttaatattggaagcaagcctgaagcacccctcaactctataaatctgaatttctactcagcaaactccataccatccaaatttgataacttagaccatgccattctcaccacttccgagcttatcggggtcagctcttacctgcttaaagatttctgctcaaacacccaaaagtattacagatactttgagatccccaagaagtccgggaaaggggtgcgcgtgatttgtgcaccacgtgcctttttaaagaccgttcagtactggattctggactacttcctgctgagactgaagcagcacgagagttgctactcatataggaagaacaagtcaataaaggacaatgccaatgcccacattaataagaaattcatcctgtgcatggacatcgagtcttttttcgataacatttctatcaagcaggtcgtgcaatgttttactgaaaactctatatcgccgcacctcgctatcttgttcgctaaactcgtcacgcttaacggatccctgccacagggtgccccaacaagccccatcatcagcaatagtcacttatacgaattcgatgattacatctccaaatattgtgcagagaattccctctcatatagccggtatgcggacgacctgacgattggcagcgatgattatgatgctctaaagaagatggaaaaactgatcacagaggagctcggctctttcggcctaatcattaacaagggcaagaccaggatcataagcttcaattcttgtcagattgtaactggcgtggcaatcaataacggggaactaagacctacccggaaacacagaaaggaagtacgagctcttttccatcgggcggaaatcgaacggtctgtggagttactgccgaaactctatggacatctaaattacctgaaatcgtttcgcaacggcgactcaccaaaaaacatccagaagtatcagtccattattgatcggctgaagctgctgaggaacattgagggcttcggaagcgagacatga

SEQ ID NO: 14201 - RNA, 1452 nt, unidentified
  source 1..1452: mol_type = other RNA; note = synthetic construct
atgtcttcggagcttaatctgaaaacctttatctgggctctgggagtcattcagcccgcaactcctaacgaagtgcaaaatttcattacccacatgcttctcaaacagagtaacaaggagttcgatattgagacaactgtgaaaaagttgatcaacgaatgtctgattcggtgcgtgtccaagaggaacaagctgtattccatcactcacgaaggagatgaatttctgggtaataaacttagagcactcaaagacaaggagagactctatctcttaaagtctgtacgagatgtcacctttgtcggtaagggggcctcagaaagaaacaccggcggagcatctcccttgaagcaggcgcggagttccaccaaggtttcacccagacccgagatccccctaccttccgggcctttaccacaaaatcaacgcaatttttggccgcgggtatactggcagctgaatattgggtccaaaccagaggccccactcacctccacacacctcaatttttactctgctaacagcataccgcgtaaattcgacagcatggccgacgcaatcatcaaaattagcgagctggtgggtgtgagctcctatttactcaaggacttctgtaacaacacagagaaatactatagagacttcgagatcccaaagaaatcagggaaaggcgttagggtgatctgcgcgcctcgagccttcctgaagacggtccagtattggatcctggactatttcttaatccgcctgaaggagcatgagagctgttacagctacaggaaaaacaagtccataaaagataacgccagcgtccaccttaacaggaagtttatactgtgcatggacatagagagttttttcgataacataagcgttaagcaggtggctaagtgcttcgtggagaacaaaattgagccccatctggccgccctgttcgcaaatatcgtgaccttcaatggcactttgccacaaggagctcctacatccccggttatctcaaacagtcacctgtacgaatttgacgaactgatctccaaatattgtgtcgacaacaatctgtcttactcacggtacgccgatgatcttactatagggtctgatgactacgattcattgaagaaggtggaaacactgatttctgagaaactaagctcttataccctcaagctgaataaaaagaagacacgtatcgtatcaagcaatagttgccagatcgtgacgggcgtggccattaataatggagaactccgcccttcgcgcaaacataggaaagctgttcgggctctattccataaggcggaagtggagaaaagtgttgaacttctgccaaaattgtacggccatttgaattacctcaagtcctttaacaatggcgatactcccaagaacattcagaagtatcagagcatcattgacaagctgaacaatcacaagaacattggcagtttttga

SEQ ID NO: 14202 - RNA, 1455 nt, unidentified
  source 1..1455: mol_type = other RNA; note = synthetic construct
atgattgatgtgatgaatagcaaggtattcgtgtgggccctaggcgtcattcagcctgcaaaaccagaggaagtacttgactacctcttgaaggtgtttgccagcgagaaacagaaggatttcaaggtagaaatcggtcccacattatcaatcgtccttgaacagggattagtccactgcgtatccaagaagaataatctctactccgtgaaacatgctggtgatgatttcttaggcaataagcttagagtgcttaaagataaggagaggctgtatctgctgaaaagtatgcgggacgttaacttcttgtcaaagggagctagtgagcgaaatatgggcggagtttccccacccggacggttgaggtctagcactaaagtgtctccacgcccagaggtccccttaagtctgggaccgttgccgcagaaccagcgtaacttttggcctcgagtgtaccagcaactggggatcgggtccaaaaccgaagctcctctccagcctataaacctcaacttttattcggttaacaccctgccagaaattaaatcaaggagcgaggctatttttgctgcttccgagctgattggcgtttcttcttatctgctgcgggacttctgtaatagtaaggagaaatactacaggaagtttgaaatcgccaaaaaatcctccaacgagagcagagtgatcaatgcacccagagtgttcatcaaaaccacccaatactggatacaggactatttcttttaccgcctcaggcaacatgattcatgtttttcataccgcaaaaaagtgtctatcaagaacaacgcctcagtgcacctgaacaaaaagtttatcctctgtctggacatagagagtttcttcgataacataaccaaaatgcaggtcatcagctgtattgcgaagtctaaggtcaatgtgcatctggcggagctttttgcagacattgtgacattgaacggctgcctgccacaaggcgcacctacgtctcctattattagtaacagccacctctatgaattcgatgagaagatctttgagtattgctccagcgccggtatgtcctacagtcgatacgccgacgatctgacaatcggggccaacaaatatgattcattgaagacgctagaaaaggtcgtgaagaccgagctggagactctggggctgagcattaatagaaagaagactcggattatctcctctaatagctgccaggttattaccggtcttgcaataaataatggcgaaatccgtcccactcgcaaatatagaaaggagatacgggccctcttttacaaggccgacgacgcgatcgacatcgaactactgcccaaactgtgcgggcacctcaactacattaaaagcttcaaaaatggggacacaaagaagaacatcgaaaagtatcagctgatcatcgacaagctcaaaaagtcgaagaatattcagacattctga

SEQ ID NO: 14203 - RNA, 1440 nt, unidentified
  source 1..1440: mol_type = other RNA; note = synthetic construct
atggaatccactataaatctgaaagcctacctgtgggccctcggagtgatccagccagctaaccccgaagaagtccatgacttcctgaaattcatgaacaacaacaccaatgacatctactcttcttccgacatcgatgacgccgttgcattcagcctggagcacaaacttatcgagatcgtgtccaaaaaaaacaatctgttcgtcctgagccttaacggctccgaatttttaggcaagaaacttaagctcctccgggacaaaaatagactactgctactgaagtcgctccgaaacgactcactggaccgggaggaatcccccgagcagaagatggatggcgttccaccaagctcaatgtttcgcctgtccctcaaggatgcccctagacctgaggagtctctcagcagtgggcctctgcctcagagccagagattcttttggcctcgcgtgagcgaacagctgcagattgggagtaacagtggcgactcatctacgcgaatacggttgaactattacagtcgtaataagataccagctaacactgagcaatccgcatatgaatgtttggcagagctgatcggcgtcagcccgcgcttactttcctcaatggccaagtctcccaaaaaacattataggactttcaccatggccaaaaagagcgggggcacaaggcttattagtgcccccagggcttttattaagaccatccagtattggattacggattattttctgtatcgtctgaaaacacacgaaagatgcttctcctataaaaagggtctatccatcaaagataacgctaggctgcatttgaataagaaatacatcttatgcctggatatcgaatcgttctttgacaacattaaccagaaggatgtgattaacctcttgataaactcaggaatagaaaacaagctctctattgctatgagttttttgctgaccctcaataatacattaccacagggagcaccctcatccccgcttatcagcaatgcccacctcttcgacttcgataagaagatcactgaaatcgctaacaatagtaatgtgacctacactcggtacgcggatgacctgacatttagctgtgaccaaaaaagcactcttgagaagattaaggtgattgttaacgagaagttaaacgagattgggctaaacattaagaatgataagacaaggatcctctctgagcacaattcacaaattattacaggtatcgccgtcaacaataataatctgcgcccctcgagaaagttccgaaagaaagtacgggtgctgttttaccaagcgaagatcaataatgatgtatctcagatcccaaccttgagggggtacttgacctacctgaaatcttttgagaatggagacacccctgagaactataagagctacgagggtaccataaattacctgcagaagatccagaaagcatga

SEQ ID NO: 14204 - RNA, 1464 nt, unidentified
  source 1..1464: mol_type = other RNA; note = synthetic construct
atgatggcgagtccaatgaattccgcaataaacatcaaagcctatctctgggctctgggggttatacaacccgctacgcccgaggagattcacaactttctaaagttcatcaaccgctctgaagaggagatttacgacgccgataccataagcgatactataaagtattccatcgataacggtctgatagaaacagtgtctaagaagaatgagctttacgtgctgagtctggtgggcggagaatttctaggcaaaaagctgcgtctgttacgggataagaatcgcctcctcctcctgaaatccctgaggaacgactcattcaagaaagaggggtttcccgtccaggaaatggtgggcgttagccccagtgaaacccaaaggctgtcactgaaggccgcacctcgccctgaggaatccttgtcgcccggaccgctcccacagaatcagagattcttctggccacgggtttcagaacagctcaagattggtagtacatctgggaatcctagtcctagcattaggctgaactattatagtcggaacaaaatcagcaacaatagcaatgtgactactatcgactccttggccgagttaattggcatctcaccacgcctgctgtcaagcattgtgaaaagtcctgagcaacattaccgcgccttttctatgcagaaaaagtcgggaggtctgagaagcataaacgccccccgagcgtttctgaaaaccatacagtactggatcaacgactacttcctttataggttgaagattcattctaactgcatcagctaccgaaaaaaggtcagtattcgggacaatgccgccatccatctgaacaaggactacgtactctgtatggatatcgactccttttttgacaacattaagacgaatggagtatatactctgcttgtcaattccgggattgacgagtctctttccagaaccatcagcttcttgaccacattaaataataagctgccccagggagctccatcttcccctctgatttcaaatgcttacctctacgattttgacagcaaaattcacgacctctgcagcaagatgggcatctgttactctagatatagcgatgatctaacattctctggcgataataaggagaagcttgaagccctggtgccggaaattattgagcaattggactgcttcaacttgaagatcaaaaagtcgaaaacccggatccgatcccggaattcaaaccagatgattaccgggatctcaatcaataatggcattttgaggccatctagaaaattcagaaaaaagatcagggcggcattcttcaaagcacgttctaacaataacatcggcgctatctccacactgaccggatatcttaactacttaaagagctttgaagcaggggatactgaatacaacatcagcgagtatcagaaaacaatcgagcaccttaaagctctcaagaactccataaaaacttga

SEQ ID NO: 14205 - RNA, 1449 nt, unidentified
  source 1..1449: mol_type = other RNA; note = synthetic construct
atggagaacatcattaatgtgaaagcctacctatgggctcttggcgtggtgcagcctgcctctcccactgaagtgcacgacttccttaaatatattaaccgctcagaaaaggagatatacgatgagtcgtctatcaaggaagtgattgagtatgctctcaacaatcactttatcgagaaggttagcaagaagaacaacctgtttatattgagttcatacggagcagagtttctgggaaagagactgcgattgctgcgtgataagaatcggctcctgttactcaaagcgctgcggaacgacatcctcaagaaagagggactattcgaacagaacctggacggcgacagtcccagcccaatgtttcggtccacctcaaaggtagcaccaaggccggaggaaagcctttcaccagggcctttgcctcagaatcagagattcttctggccacgcgtgtcagagcagctcaagatcggtagcttttccgagggcccatcaaattttcaccccatcaatctgaactactatagcaagaataagctggacagcgcctcaaatctgagtccggtgaacgtgctttcagaattgataggcatttcccctaggctcatctcgtccatggttaaaagccaagataaacattatcgtacgttctccatgcccaaaaaatccggcgggtacaggaagattaactctcctcgggccttcctcaaaaccgttcagtactggataggggattactttctttatcgcttggtcaatcatgaaaactgcttctcttataagaagggagtatccgtgaaagataatgcgtcggttcatctgggcaagaaatacattttgtgcatggacattgattcctatttcgattgtatcaacgtacactcagtattcaaactcttcgtcagatccggaatcgacgaaggcctgagtgacctaatgtccaaactggtcacactgaacgggacactcccccaaggatctcccgtctctccattaattagcaactcctacctctatgattttgacgtgttcatttctgacttttgttccagctacaatatcacctacagccgatatagtgatgatctgacgtttggtggagacgataagagcgacttggaagccatcattggtatagtcaagaaaagcttaagtgagttcaacctgaacattaaagacaataagaccagactgctgtctgaaaataatactcagatcgttaccggggtggctatcaacaatggtgtgcttagaccttctaggaggtttcgcaagacagtgcgggctatcttccacaacgcattagtcactgaatctgtgggcagtatcctgatgctatccgggtacctgcattatcttaaaagttttgagtctggcgagacaccccacaatataaaggcctatgaggacatcattgagaaactgaagagcaagtacgtcagcgtttga

SEQ ID NO: 14206 - RNA, 1452 nt, unidentified
  source 1..1452: mol_type = other RNA; note = synthetic construct
atggatgagaacttcaacccccgacctttcttgtgggccatcggaatggcccaaccgaccaccctggactatgcccatgctttcctgaagaaggtgacacagtcagagtcagacctgctcactattgaagagatcaacaacttctccaagtttgcactcgacgctggactcattgaggtagtgagcaagaagaataagctgtattcgttaacgaacgagggcggcgttttcattggaaaggggcttagacttctacgagataaaaatcggctgcttttgttgaagtctttccgaagagctaaactaacacaggagtcatcaccaactggaaacctggcgggtgctgccccagtcgtgaggaatagctccgcattaaaggccgctccacgtcccgaagtgagccttgccagtgggcctctgccgcagaatcagcggaacttctggccccgcgtctctgagcaattcaacatcggactgatagtgggcgaactgagtcctagtattaacctgaatttttactctcgcaattccttccctgaagtgtccgactccatttctgccatcgatgccttaagtctctgtattggtgtcagcccacggttgattgggagcatgtgtcatgcgcagtctaaccactacaggacttttaccttgatgaaaaagagtggaggcaccagaacgatcaatagcccacgggcatttctgaaaaccgtgcagtactggatcaaggattacctcatctacaaactgcccgtgcacgatgcatgcttttcttatcgtaaagggctgtcagtaaaaaataatgcatgcgtgcacctcaacaagaagtacattctttgcgttgacattgacaactattttggcagcattaaaactgagtttatccacgctatgttgcacaaattcgatttcagtatggaactctcagaggttttatcccagcttatgactctggacggatccctcccccaaggtgccccaacttctcctgacattagtaatagctttctctacgactttgacgttaccgtgtctgattggtgctcagcccataacgtaagctattcccgctactccgatgacctgacattcggtctagattccatagatatcataggcgatctgaaagacttcgttataaacagcctgctgaggctggggctcagactgaaagaggagaagaccagagtcatgtcttgtaataatcgccagatgattacaggggtcgtgataaataatggcacacccaggcctagccggaaatttaggaaaatggtgcgcgcggccttttttaatgcacaggacttgggcgatgtcagttccatcaagaagttaaggggttaccttaactatctgtccagcttcgagggcggggacacaagcgaaaacatcgctaagtattcaaagatcatctcttcgctcgaagaaatcaagatcaaaatgaccaactga

SEQ ID NO: 14207 - RNA, 1461 nt, unidentified
  source 1..1461: mol_type = other RNA; note = synthetic construct
atggcattgactatcaataaggacataatcgtgtgggggctttcagtcattcaaccagcatcgatttccgaactccggggcttcctgtgcgcagtgacacaggacgaaaacgtagtgcctgatggagattaccttgccgtaaccgtgaaggaactgattctgatccacaacgttttgaaagtcgccacgaagcctgctcgatattctgtcacccataaaggagggatccgcctcacaaaaaagctgcggtacttgagggaccgcatgcgactttttctccttaaggactctgcctatggaaggtttcaccttagctcagatgtcttagatcagaatctggatgacgcctcttcaagcagctctatcgggttaaaatatcaggatgcacagagatccaacagctttctcgctgccgatcagaaagcgatctggcccctagtgtccgagcaattccagattggctctacctctgcttcagatgacaaaaatacccctacttatgccgatctggactgctacagcttcgatagcgcgtatttcgaaggatccctaaagaacacatcagatctgagtgaggcaatcggagtgtctattcgcttgataacatccatatgcaagaagaaggagaagcactaccgcagttttgaaattcccaaaaaaagaggcggcaccagaccaattgatagtcctagaacattcctaaaggtcattcagaaatggatcaacgattatttcatctacgacctaaagcagagcaattactgttacagctacaagaaaggtgtgtccataaagtctcacgcgcagtgccatgagaagcagaattatgtggcttgtgttgacatcgaagacttctacggctccctgacaaaggatcacatctataacctgctgctcaaaaacaataaggctcattccatcgccaaggtggtttcagacctttgtacctttaataataagctcccacaaggcgccccgacgagcccaatactgagcaacgccttcctgtatgacctcgacaattacctggtgtcagagtgcgagggtctgaatgttacctatagccggtttgctgacgatattactattagtagcgacagtaaagagaatttgattcgactgatttccatgatcaaaaactgtttacgttccctgggcctgtctctgaaggactcgaaaactcggatcttgcataaaagtcagaaacaattggtgactgggctggtcgtgaacgagatcgctaagcccgccaggacttacagaaggcgtatccgggccatttttcacaaggcaaagctttaccccgactcattcaagggtaaagagaaagtactgcaagggtacttatcttacctctcttcgtataactgtctctccagcgacacgcagagtgactacaagcagacaatactgaacatcaagaatctcaccagttcaagcaacagggataaaaactcctga

SEQ ID NO: 14208 - RNA, 1428 nt, unidentified
  source 1..1428: mol_type = other RNA; note = synthetic construct
atgacagtgtcgattcgcagagatatcttgacttgggccgtggcagtgatccaacctgccaccatttccgacatctataacttcctgactacagttcttaaggacaaagatgctattccgagtcgggatgctattatgatcgaagtgctggccttaatcgagttgaatgacattgctcgagtgtcccaaaagccaacaaggtattctatcacagccaaggggaacaaccggctgaataaacggctgcggcacctacgtgatagaatgcgtcttttcctcttaaaaaatgcttacaggggcagtctgaaaaagcccagtgctatatttgatgaggaaacgaacgacgtgtcttccttcatcagaaaggccgtggagattaaagatgcacagaggcctaattcttctttggtagccgaccaaactgccgtctggtctttggtgagcgagcagttttctataggtcctaatgaggtcgcggacggcgttctgctgattccaacattctactcatttgatgcgaattactttgatggagaactgaggagcatagtcgacctgtcagaggcaattggtataagtatccgcctcataaccagcattgtgaagaacaagcagaaacattataggacctttaccgtcattaaaaagagtgggggagagcgggtcattgatgcaccaaggacctttctgaaagtgatccagcgatggctgagcgattttctgctggacaaactgcccgtgcacgacttttgcttcagctacaagaagggacagagcatacgaaacaatgcgcagattcatgttggcaagaagttcgtgctcaacatcgacatcaaggatttcttcggttcaatcactaagaagatgatctgcattaccctcatcgagtcagggttcgaacataaactcgccaagattgtatccgagctctgcacttacaatgatagacttccacaaggcgctcccagctcccctatcctgtcaaactctatcctttacaagatggactgctttttaactgaacagggagcactcttcgattacaactatagccgatatgccgacgacattacgatctcaagcaatgatagattgactatggagctaggcagggagacaatctttcggtgtctgaatgaatcggggttcgacatcaacggaggtaaaacccgcgtggctgcaaccaacagccgtcagatcgtcacagggcttgtagttaacaaacgggtccagcccacaagagtttatcgccgcaaggtaagggccatgtttgactacgccaaaaagaatccggactccttcaccgacaaatattctatgctgaccggatgtttctactacctcatgtcctttggctgtattggccactccaagataaacgaatataaaaatacgctctccctattgcgcgaaatcagtaagagatga

SEQ ID NO: 14209 - RNA, 1497 nt, unidentified
  source 1..1497: mol_type = other RNA; note = synthetic construct
atgagtgtctttatcaacactcgcctcatcaggctgggcctggggtgcattcaacccgcttctgccgaggatgtgagcaaattcctggcccagacgctcggaacagagggtgctcccatcccccctgaaagtatccaatctattttcgatgactgggcgtcccaacaggatgtagtttgtgtgcaccagcgccagcatctgtattctcttacaagaaaaggtgacaacgcactcgatctgcgagagcgacgtctacgggataaaacacgcttattccttatcaaggaactgcgggccgctactctgaagaggcctgaggctgaggaaccggaaaaggccgacgactcctccgccgtggccattgattcagcaacccagggggagaggcctaaaggggctgctgctaatccaagagctgcgccgggagttggacgggctttttggccactgctgagcaaacagctgtttgtgggatcttcaccccaggcctctggactccgtttccgatttttttcctttccctcgattcttgactgttgtaaggccgctgggggcaccagcataccagaggacggcgtgggagtgaacgagatttctttggccttgggcatttccccatcgctccttaagtccttcctcgcgaggcccgagcaccactacagagtattcgaaataccaaaagcaaatgggaagatgagacagattaatgccccacggaccatgctcaaggttttgcagtacttttttgtggattacctgctggacaggcttgctgtgcacccagctgccaccgcatactggagggggagctctgtcaggaagaatgcggagaggcatgcccgccagagatacgtcgccaacatagacgtgacaaattttttcccgagcctctcaactggcttcgtcattcgcagcttatgcgccgccggtctgaaacctgacaccgcagccttggtggctcgcctgtcatcatacaaaggcgggctacctcaaggagcccccacctctgcagcactttccaacatcgtgatgtatgggtttgacaaaaagttaagcgaagcctgcgcaagcttgggcgtgaactatactcgctatgcggatgatatgactttcagcggcctggagctgggtgcaatccaacagagtatcaaactagcaaacgaatcattagccgagatcagactcaagataaatgacgaaaagacccggatctacgggcccagtacaagacaggtcgtcacaggagtggtagtgaatgattggcctcagcctagtcgggtcgagcgaagaaggctgcgtgccgaactgcaccatgcaaagttgagtcccgccacgttcgttgccaagtaccagcagctgcaaggccgggctgcctatgttcttagctatgctggcgaagagcggcctgttggcgcactctccagaggctatgtagaagaggcattgttcgacgtgcgacggctgcatcgcctgatgtcccagaccggaggtgcgtga

SEQ ID NO: 14210 - RNA, 1488 nt, unidentified
  source 1..1488: mol_type = other RNA; note = synthetic construct
atgtcagtgaatgtaaacacccgcctcattaggctagggctcggctgtatccagcctgcatccgccgacgacgtttctaaattcctggccctcagcctggaggtagaagaggaacctatatcccctgaggccatccagataatcctggatgagtggtccagtcagaaggatgtggtttgcgtgcacctccgccaaagactgtacagcttaacccggcagggcgacggaagacttacacctaaggagcgacacctacgagacaaaactcggctcttcttgcttaaggaactgagggctgcaactttacggcgcccagaggccgaagagccggagaaagccgatgtaagcagtgcggttttcattgacagcgccacccaagaagaaagaccgaaaggagcggccgctaaccccagggttgctcctggtgcaggaagagctttttggcccctgcttgcgaagcagctctttgtgggatccagtccatcggcgagcgggttgagattccggttttgctcctttccaacgatatccgactgctgtaaggccgctggcgacgattctattcctgccgatggcataggcattaacgagatctcattgggtctgggaatttccccgggtctgctcacgtcattcttggctcgccccgagaggtactatcgagtctttgagatcccaaaggcaaatgggaaatctcggcagattcaggcaccccgcacaatgatcaaagtcctgcagtacttcttcctggactatctgctgaattggcttgaggcacatcccaccgccacagcctatagccggggaagttcaattcgcaaaaacgcccaagtgcataccgaaaagaaatacgtcgccaacattgacgtgtctaatttctttccctctctaactatcggcatcgttgctaagtccctcgtggctgctggtttgtctagtaatacagctgtgctcgtcgcccggctgagttcttataagggcgggttacctcagggagcacctacctccgcagctctttcaaatatcgtgatgagggaatttgacgccagcgtgtcggaatcatgtaatagcttgggggtcagctataccaggtacgcggatgatatgacattttctggaatggagctggacggggtgaaacaagcaatctgctttgcaaaggagaggctgactgagatgagactcaccctgaacgatcagaaaacgcgtattttcggcccagggactaggcaagtcgtcactggggtggtggtgaacgattggccacagcccagccgagtggatcggcgtagacttcgtgcagaactgcatcaggccaagatcagcccagctaattccgtcgccaagtaccagcagctattaggccgagctgcttacatgctgtcatatgcccgcgaagagaggcccgtaggcgcaatcagtagagcctacgtggaagacgccctggccggtgttaagatgctgagacacttcacacacaacgagtga

SEQ ID NO: 14211 - RNA, 1551 nt, unidentified
  source 1..1551: mol_type = other RNA; note = synthetic construct
atgagcgtgggagtgaaccagagcttcgtgcgactggccctcggatgcatccaacccgcctctgctgaacagatcgcagccttcatctctagtagtcttcctaccggggcgcaccctttgcatgctgagaaaattcgggaagtgctggatggctgggcgtccagcggagacatcctatgcgtccataagaggtatttactctacagtcttactagacagggggatgggaagctgtcggcacccgaacgcaaggtgagagacagaaccaggatgtttctattaaaagatcttagaagcgcctccctcagagccagcgaagtttggggaatcgagcaagccgatgactcctctgctgtatcacacggtatggcagtgcaggaggacgaaaggcctataggcgcagctgtttcaccgagaaggcgtgacgggcgagcctattggccactgctgagtaagcagttgctggtggggtcttcgtccccatcatccgacacccggtttagattcttgtcgttttcttccgtcaggagttgttcccaggcctgcgggtatgccgatatccccgaggggggcattgggctgaacgagataagcctggcccttggagtgtctccccgcatcgttggtctgctcctccgcagacccgaatcacactaccgggtatttcagattccaaaggccggaggcggcctccgggaaatacatgcaccgcgtacattcatgaaggtcactcaacactttatcctggactatctactccggcggctgaaagtccatccagccgctactgcatactccattggttgcagcatcaggcacaatgctgagatccacgtcaggcgcaggtacgttgctaacattgacgtcacaaacttcttcggctcactttctacctctgtggtttacgatcgcctgattgcggtcggcctcatgaaaaacacagccgccttcatcgcacgtatttcatcatttatgggcggcttaccccaaggagctcctacaagcgccgccctaagtaatatctgtctgtacgctgcagatgatgtcctgcaggccgaaagtacggtaaggcaggtgacttatagcaggtatgccgatgacattacgttcagcggcgacgatttgggcgcagtgcaggcttgtatggccattgccagaagagagctgagcgcgctgggactgacattgaatactgataaaacacgcgtgttcggtccatctagtcgacaggtggtgaccggagtggtcgtgaacgaacatgctcaaccggctcgaaaggagcgccgtcgactgcgagcgatgctgcaccacgcaggtaccgctcccgacgagtttgttgcccagtttgacatactccaggggaaatcctcatatatgttaagctactccacccctgagcgcggaattggcgcccttccagaaaagtacgtggaggacgctttggctgccgtacgggcagctcggaagaaaggtctgcctgccgcagatgagtcttctctctcctccgcgcctttcgacaatgagaatcggggccgcgacgcaatcagctga

SEQ ID NO: 14212 - RNA, 1473 nt, unidentified
  source 1..1473: mol_type = other RNA; note = synthetic construct
atgaccgttagagtgtatcctcagttaatccgactggccttagcgactattcagcctgcctcggctgagactgtggtgagatttgtacagagtgccctcgactctcaggagcagttactcgatctgagcgaagtacaaaaactcatcgaaaactgggaagagttagccgatgtcgtgtgcgtgcataagaggtaccagctctactccttgaccaaaagaggagcaaacaagctgagcaaaaccgagaggcagctgagagataaaacccgtctgtttctgctcaaagaactgtgcgtgagcaagcttaagagccccgaggtccaagagactgagaaagctgacgccagtagcgccgtagttattgaacccgtgcttcaggaggacaaacgcccaatttccccagcagttccgccaaggcctgctaggagtagcggacgcggctactggccactgctgtccaaacagctcttcgtgggatcttctacattgacatccggtcctcgacttcgctttctgtccttccagagtgaaaagtcttgtgttctcgcgtgtgggacgaaagattcatccgaatttggcatcggggtcaatgagatcgcactttctctgggcatctccccagggctcttaaccagtatgcagcacaaacccgaaaagcattataggaccttcgaaatccccaaatcaaacggcaagccccggctcataactgctcctcggacaatgatgaaggttgtccagtatttcttcctggactacgtactgcgcagtcttcccgtgcatacatcagcaacagcctaccagcggggctgctctatcaggcaaaatgcgctgcagcatctgagacaacgttacgtcgccaatattgatgtttcagacttttttccctctctgactaccgcagtggtgacacagaagctagtggagggcggtctgaagattaacactgcacttctggtagccaagctatgtagctatgacgacggcctacctcagggtgcccctacttccgccgcaatttccaatatcgtgttgttcgattttgataccgctatgtcagaatacgccggcttgcacggcttgacatacaccagatacgctgacgacatttcaatcagtgggagcgagaagtctgagattgagaaagccatctcggtcgcacaaaaactgttgtcaggtatagggcttaaattgaatgattccaagacccgcatattcggacccagttccagaaaggtcgtgacgggagtggtcgtgaacgaatgggcccagccgagccggaagcaaaggcgaaatctgcgggctgctctccatcaggccagcctgcacccagaacgctatgttgacaagtatcaccagctgcaagggaaggctgcctatatgctaagcttcgcgacgccagagcacagcgtcggaggactctcatctgagttcgtgcacaacgcaatagctgagattaagaagcggatctga

SEQ ID NO: 14213 - RNA, 1521 nt, unidentified
  source 1..1521: mol_type = other RNA; note = synthetic construct
atggcaataatgataaattctcgcatcgtccgcctggccctgggttgcatacaacccgctgacgccaacgccgtgatcgcgtttctgatgaaggcctttaagtatgacaccaacctcatcagcgagtccgcaattcaggaaatcttcgaccagtggagtaccgatggtgaagtggcgtgcgttcataagaagtctaaactctactccctgacacgcctcggcgacagtcgactgaaccgggaagaacggaggctccgcgatcgcacccggttgttcctcttaaaggagttacgaagcgcaaagttgcatctgcctgaggccggtgagccggaaaaagctgatgtgtcttccgctgtcattgtagatcagcccgtccaggaggacgagcgaccaactggagccgcacgtcctcctagggtagccagaagggctgcgagagcctgttggccactgttggctaaacaactgtttgtgggctcctctagcagggccagtggacccttctttagattcctgagttttcctacagttaaggcatgcgcacaggccaacggcttagcggagattccacaggatggcatcgatatctcagagattagtctggcaataggcatttcaccacagcttattggactgttgattcacagacccgagcggcactacaggacttttgagattccgaaggcaaatggaaaggtgagggagattcagtctcctcgtaccatgatgaaggttgttcagtacttcctattagactacctgctctacaagcttcccgtccacgtatcggctaccgcatattcccgcggctgtacagtgaaggccaacgccgctccacatgtggggaagaaatacgtcgcgaatatcgatgtggaagacttcttcccatctatcaagtggcagctggtgcacaaaatgctggccctaggagggctggaggacaaaactgcctatttgattgcacggatgacgtcgtatcaggggggtcttccacaaggggcccctacttcagcgcacttgtccaacgtggtcctatatccttttgacaaagaaatgtccggcttttgtgagtccgtggatgtcaattacacacgttatgccgatgacatcaccttcagcggttcagacaaaaatgtggtctggagcgcagtggaaagagctaggcagctgcttaccgaccttgggctggagatcaacaaagaaaagacacgggttttcgggccgagctctcggcaggttgtaacgggcgtggtggtgaataaatgggcccaacccagcagagagaagcgaaggaaacttcgcgccgagctgcatcaagccaagatgaatcctgaaaaatacgctgctagagccgatgaaatccggggaatgtcagcctatatgctgagcttcgcttccgaggagagagccgtcggagggctctctaggggctacgtggaaagctcactcgctaaactcactgaatacatcaacgaaatgaaagctaaggagagcgcaatcgctccccccagtgctccctga

SEQ ID NO: 14214 - RNA, 1521 nt, unidentified
  source 1..1521: mol_type = other RNA; note = synthetic construct
atggccattaatatcaatcagcgcatcgtcaggctggctcttggctgtattcaacccgccgacgctggcgctgtgatcaagtttttgagcaaggccttcaactacaataccggctatttcccggagggatctatacaggacatttttgacgagtgggccagtgatggcgacattattaacgttcataaacgaaccaaactctactccctgacgaggcaaggtgattctagactgaaccgggaagaacggcggctgcgcgataggactcgattattcctcctaaaagagatgcgcagcgccaagctgcatttgccagaggcaggagagccagaaaaggcggacgtgtcttcagccgtaatcgtggacccacctctgcaggaagatgaaagacctacaggagcggctcgaccacctcgtgtagctcgcagagctggacgggcttgttggccccctttaggaaaacaactgttcgttggcagcagttccagggcttcgggcccatattttaggtttctgtcctttccgaccattaaagcctgcgcccaggcaaacggcttagacgaaattcccaaagacgggatcgatattggcgagatctcattggcaatggggatctcgccccagcttataggccttctcatccacaagccagagcgccactatcggacctttgaaattcccaaagctaatgggaaggtcagagcgatccagtccccgcgcactatgatgaagatggtacagtatttcatcctggactacctcctttacaaactgcccgtgcacatatccgccacagcctatagccgcggatgcaccgtgcgagccaatgctgaggtgcatgtaaggaaaaaatacgtcgctaacatcgatgtggagaactttttcccaagtatcaagtggcagctggtgcagaaagttctcgtgatgggtggattggaagacaaaactgcctacctgatatctcggctgacatcctaccaaggtggacttcctcagggggcgcccacatcagcacacttaagtaatgtcgtcctgtacccatttgataatgagataagcaacttctgcgaaagcgtgggggtcagctacacaagatacgccgatgatattactttcagcggggacgataaggactcagtgaggtccgctgtcgagaagagcaccaagctcctgtctctgctgaagctcgagatcaacaaagataagacaaggattttcggcccctcttcccgtcaggtggttactggggtcgttgtgaacgaatgggcacagccttcacgggagaagagacgtaagctcagagccgagttgtatcaagcaaagctaaatcctggcaagtacgcaagcagagccgacgagctccagggcatgtctgcatatatgctatcattcgcgggggagaaccgacccgttggtggattgtcccagggttatgtggagtcatctctggcccggcttacggcatatatcaatgccatgaaggaacaggaaagttccaccgtgccccctagtgcaccttga

SEQ ID NO: 14215 - RNA, 1488 nt, unidentified
  source 1..1488: mol_type = other RNA; note = synthetic construct
atggcaattatcgtgaacgttcagttggtcagactggccctcggttgtatccagccagcagacgccaattccgtctccaagttcttgggagcttctctgatcggcgatgacaacttactctccccaagcgttatccagactgtgtttgatggctggatagcagacggcgatgtcgtgtcagtgcataagaagtctcagctgtacagcctgactcgccagggcgacaaaaaattgaaccccaaagaacgcaaagtccgggaccggacacgtctgtttctgcttaagaacctgcgggcggcgaagttacatctcccagaggccggggaaagcgagaaggccgatgtttccagcgccgtgatagtggatcaacctctccaggaggacgaaaggcccactggagcggtatgcccacccagagtggctcgtcgcgctgatagagcatgctggcctctcctggccaagcagctattcgtgggttcttcaagccgcgcctcaggcccgttctttcgattcctgtcatttccgaccatcaaagcttgcgcacaggcaaacggcttggattcgattccctctgatggtatagggctgaatgagatctctctggccttgggtatttctcctcagctgataggactgctcattcacaagccagagcgccactacagaacgttccagattcctaaatccaatggtgggacaagaaatattcagagtcctcggacaatgatgaaggtggcacagtactttctgttggattatgtgctttataggtgtccagtacatgtgagtgctatggcgtattcccggggttgtaccgtccgcaacaatgccgaggtccacgtaggccgacgcttcgtcgctaatattgacgtcgagaattttttccccagcctcagcaggaaaattgtttttagggagcttatcgccagtgggatggaaacaaatatggctagcctggtgtctagacttacttcttataacgatgggcttccccagggagctcccacaagtgccgcactcagcaacatcgcactgtacagaatcgacgacgaggtgtttaactattgccagtccattggcgttgaatacacccggtatgccgacgacatcaccttctcgggcgaaagcctcgaggccgttcaaggggccattgagaaaatcaaagcattactgaactccataggcctggtcatcaataagagtaagaccagaatcttcgggccttccagtcgaaaggtggtgactggcgtggtagtgaacgaatgggctcaaccaacccgaaaatcaaggcggaagcttagggccgaactccaccaagccacgttaaatccggagaaatatgctggacaaattgacgtgatgaggggaaaggccgcctacatgctatcctacgcgggagaaggacgtcccgttgggggactacctagggggtacgtagagtcaagtctggctaagctggctgcatacatcaaggaacacaaaggctga

SEQ ID NO: 14216 - RNA, 1005 nt, unidentified
  source 1..1005: mol_type = other RNA; note = synthetic construct
atgctgccggcgctataccccttcggcacagcccagagatggttagaggtggcccccgccttttttgacgagacaggcgtagctcaggcacagcagctcttggagaaaggggtgattccagtacagctcggtcccgaaatagcgatctacttaggtgtttctccaaagttggtgagccacatggtcattcggcctagtcggtactataacaccttcgagatcacgaaaaagaatggctcccgacgtctgataactgccccgcgggtgtttctgaagaccgttcagcgttacgtgctggattgcatcctgtcacaggtccaaccacatgacgcggccgtgggctttcgtcgaggtaggaattgtggagatggggccaggaggcacgtgggaaggccttacgtctggaacatcgatctggctgattttttccccactattacaaagcagctcgttgtcggggtgttccgagacattggctacccagacgccgctgcactgtttctaggcggactttgttgcctggaacgcaggttgcctcaaggagcacccacgtcccctgcccttgccaacttggtggcaataccaattgatatcgaactgacagctatcgcggagtcagctgggatgctttacacccgctatgctgacgacatgactttctcgagtacaaccttaattagcgctgactttagagcccgagttaccaatgccgtggaatccttcggcttctctctccgcgcaaccaaaaccaggctgatggggcccgcaactagaagagaggtcacagggctgaccatcaatcagcaagtgagcatcccgcggcatcggcgcagacagcttagagcatatttccatcacatatcccgcagccctgagcagtatgctgagcaaaggcagcaagctctgggatatgcacggtggctctacgattatcacagagaagaaggttctaacgccctccgcattgtagccaatatccctatcccacccactaaccagttctga

SEQ ID NO: 14217 - RNA, 1002 nt, unidentified
  source 1..1002: mol_type = other RNA; note = synthetic construct
atgtctgtgcacccattcctctatcctctgggcactgctgagcgctggatttcctttctgagttcctgtctcgacttatctaaaaacgatctgagtaaagctaaggtgctgctgaataaacaactcgtcccggtcatacatgggccagagctcggtatctacctgggcgtgagccctaagctggtttctgccatggttattcggacctcccgttactaccggggatttaagattaagaagccgtcagggggaaacagagaaatctgggcgcctcgggtcttcctgaagaccgtgcagaggtacgtgctagactgcatgcttgcacccatcgtaccccatgaagccgccacagggttcaggagggacatagggatcagagatggagctcaacgacacgtgggcagaccctttttgtggaacatagatcttaaggactttttcccttctattaaccaaagccaggtaaccggattgttctcgcagctgggtttccctcatcaggcgtcctattttcttagcggattgtgctgcttgcggggcaaactaccacagggggcaccgacatctcccgcaatagccaatcttattctcttccccacagatactgaaatcggcaccctggcaagaaggaacaggatcatctacacgcggtatgctgacgacttaactttcagtgggacccaccctatctcagatgagttcagacgagaggtgggcgtcctgattgaatcagcaggctttcggatcaataagtccaaaagcaggctcatgggtccccgttgtcgccgagaggtaacgggcctggtggtcaatagaaaggtttcaattccacgggaaactcgcagaaagttacgtgcccgctttcaccgcgttagcgtgcatcccgaacgatttacaaagcagaaaggtaaactcctgggctacgccagttgggtgagccagtataggccaaaagagggacacaggtatcgcgctatcgccgaggccattccatccgagtga

SEQ ID NO: 14218 - RNA, 1029 nt, unidentified
  source 1..1029: mol_type = other RNA; note = synthetic construct
atgatcacccctctggtgtctttcactagcttcgcccagttcgagcaagcccttcgggatagtagagtctcggctcattctggcgcttcattcagcaatagccttgaagtggatcgcctcgtcaaatccgctagggaactgtacgggcgcggattgccccctattgtgagctctcggaccttttctctgctgtttggcgtgtctccgcgactgatttccgcgatgaccaaaagtcctgagaagtattggagaacttttgagatcaagaagcgttcaggtaaaggccgtaacatagccgcaccaagggtgttcttgaagaccgtccagagattcttgctccgtttcgtgctggagaagatccctattcacccaaacgcctttggatttgctcccggtaagggaatttttaagcacgcggagcgccacttaaaagcaaggttcgttctgacactggatatcgctgattttttccccagcatcagttggacgcaagtgagggacatatttgcaaacatagggtttccagacggggtgccgagtctattggccgatctttgcaccaggaataaggtgtttcctcagggtgcccccacaagcccatatctgtccaacctcatcttcctaaaaacagacgaagcgctcacagaggccgctaatcagttcgagatgagatactcccgctacgccgacgacctgactttctcatgtgacagccagcccagtgacgaagcaaggctcgcctttgaacagatcattcgagatgcagggttcagaattcagcacagcaaaacacggctgagaggaccctcacaagcacgggaggttacgggcctgttagtcaacgaaaagattcagccatcccgacatacccggaggcttctgcgggccaagtttcataatctgctccgctccacttctttagaacaggagactctcccttctcttgggggctgggcttcctatgtaaattcgtacgacgtcgttaaaggcgaagagtatttgtcaatcgtacgctccaaagccagatga

SEQ ID NO: 14219 - RNA, 999 nt, unidentified
  source 1..999: mol_type = other RNA; note = synthetic construct
atgaactccctaccactgctcgtgagcttggaacacacccctgacgtgatcgccgccctcaattccgagtttaacatgacagaaatcgaaacacgcagagcaatttcactcttagataaaggtttgccccctttgtttcgtcccgaggtgattgcatatctttttggagtgtctcacagactggtcagcaatatgtctagattcagtgacaactattaccgatgctataaaatacccaaaaagtcgggcgggtttcggaatatcgagacgccacgaatcgttctaaaggtaattcagcgttggattaacacaagcattctgtccaagatcgtcgtccctgaatacatcactggcttcgccgagggtaggaacatctttgttaacgggcatattcatatcggaacgcgcaacatgcttgtcatcgacattgcagatttcttccctagtgtgttcggacgaaaggttatgtacatattccggaaccttggtttcccggtgcaagtagctcggttgctgaccgggctgtgtctgtatcagaaaaggttaccacagggcgccccaactagtcccgctcttgcgaatcacgcttttcatagtgttgacgtcaccctggaggagctggcctctgaatgggggtgtaactattcacgctacgccgacgatatcgcgttttcaggagagaggttcttcgaggactcagatttacataagattgaagacatactcgagcagcacaagtttaggataaatcacaataagagccacatttccggctctggaagcaggaagatgctggccggcctggtgatcagcgaaaaatgcattccccctagaaagaagcggaaaatctggcgcgccatttttcataacgctgctaataatcccgcaatcctgcgcgataaactcccatatctcagaggcgtggcttgcttcgtgaagcagtacgacgaagagctgtaccaaaaataccggatcataatcgattccgtggcaccgtga

SEQ ID NO: 14220 - RNA, 1014 nt, unidentified
  source 1..1014: mol_type = other RNA; note = synthetic construct
atgaatccactcccactcctcgtttctttgcctagggaacccgagtctatcgacgtcctcgctggggagcttgatctaacaccagacgagcggagtctggctgtgtctctgtacagcaggggcctgcctccactggtccatcgcaaatgtcttccttatatgttcggagtgagtccgagactgattgctgcgatgcaaaagagggctgaacattattatcgccggtttaccatcaataaacagggcgggggaacacgtgctatagtcgcacctcgtcgattccttaaactgatccagacgtggattaacggacatatatgttccaaggagaggatgccagagtgcgtaatgggtttcgtgagagggcgctcgatcttcgataatggccgggcccactgcaagaacaagaatgttatggtggtggatgtgaaggacttctttccctcagtcaccttgcagcaggtggaagccgtctttgcgtcattcggcttccctgaagaaatttgccgccagcttgggggactgtgtacactggatgggggactgcctcaaggagcccccacaagccccgcattggcaaacctcgtatttctgagcgtggatgagcggttgtcaagacaagccgccgagtggaactgcacctacacgcgatacgccgacgatattgtgttttccggcgcgcgccacttcattagcgaggacgtggcatgtctccgcgagatcttacggcaaggcggctttactattaatgacagaaaaacccgtatcgtcggtcagggcggccgacagactgtgactggtctagttgttaatggaaaagctctgccgcccaggagtaagagaagacgctggagggcaatgtttcacagggcagccaaccacccccatgaattctttgacagggctagatctttagccgggatcgctgccttcgtgaaccagtacagctccgaacgggccaccgagtatggtcggatagcccaggaagtacgagagaagtcccagcacagatga

SEQ ID NO: 14221 - RNA, 960 nt, unidentified
  source 1..960: mol_type = other RNA; note = synthetic construct
atgcaatacttggcatctgagctcaagtggtatgacaatagcttggagagcgcgttagccctctatagacggggcctgccgccattagtgacactccccaccctggctttcctctttggagttagcccgagtctggtcgcatccatcgtggccgctcctgaggcgcattacagacattttactataccaaaggcgactggcgagccccgtagcatctctacacctcgagtcgtgctaaagaccatacagaggtggattcacgactggatcctgcctcacgctaacctgcatcgcgacgcccacgcgtttcggaagtcacgcagtattttttctaacgctcagtcgcatgtgggacaagtgaatttgctggctgtggacctggccgacttttttggcagcgtacgcttcgagcaggtggccgctatttacgaagatcttggatttccatgggtcgtagcagcccagctcgcttcactcagcacactggggggatccctaccacagggagcgcctacatctccagcactggctaatgccgtcttccatgacatcgatgtgatgctggccgaattcgcaaatggccggaccgcctcatacagtagatatgccgatgatcttgctttctcaagcacctatcaccgcttctctgttagtgatgtggacgcagttagtgggatcgtcggtgtcgggggcttcaggcttaacccccggaaaactcagattgtgggtggcgggtacaggcaccaggttgcaggtttgtctgtagcatcccacccccaacccccccgatggaaaaggagacggtggagggccatgttccaccaagcctccgtggacccatcctcctttcagaacgaagccgctaaacttgccggggtggcaagcttcgttaaccagtatcgacctgatctggccgagtcctacatggaaatcgctattcgtgcctcaagaacgccttga

SEQ ID NO: 14222 - RNA, 1224 nt, unidentified
  source 1..1224: mol_type = other RNA; note = synthetic construct
atgcccacccgctcttactatttcccaaaagacttcctgcatctggaagagatcctcagagccgaaccggatggttttcccgatgaacaggctactaggttccgagacttaggactgcctccaatacctacgatgggggcgctgccgctgttccttggaatctccccgaaaacaattttttcaattcgccacctccccaagaaacactatcgcagtttcttgctcaaaaagaaggacggctccaagagggagatcgacacgccaaggacctatctaaaggtgatacaatggtggatcctggataatatattatcacatgccgagatcgctgccaatgtttttggtttcgtagcaggccgtagtgctgtgcagaacgcagaataccacttgggagctaaacacgtcctgaacgttgacattcggcagttcttcccatcaattaagttggatcaggttaggacaatctttagatccctggggtatcaggatgacgtcgctaatatgctgtctgagctttgttgcctggatggccatgtcccacaaggtgcccctacctcccctgccattgccaatctagtgctcagagagctggacatcgaactctccaatctggccgatgccgctggacatcggtacagtcgctacgccgatgaccttacattttcctctcaatctagaatcgagagcgaattcctgaatctggtggaatcggcagtccaagtggcaggatttgagctcaagcccgagaagaccaggtttagcgggtttgaaggccgcatggaggtaacaggcgtggtgattaacgagaaaccacagcccactagagtctggcggaaacgtgcgcgagctaccctccacaggttaagcctttctagcaggatgaccaggcgggagcttagttacctgcagggcctgatcggcatggctaaccagttccctaaaagcccccagatgcagcagctttcagagagcgccagattgattatggagcagaaaagccagaccattatcgggcggggaactaagcctactctgcccaacggcctcacctatcgccaagcagaggcattggctgggttagcccctcgtcggactaacattgaagtggcagtgagactagggacaacagaggcggcggtgaagaagcgactccaggaagcctaccgaaagataggtgccgctgaccggcaggaagcactgatctgggccgttaagaacttgtga

SEQ ID NO: 14223 - RNA, 1182 nt, unidentified
  source 1..1182: mol_type = other RNA; note = synthetic construct
atggagaagatcctgcaggctgagccaggaggcttttccgaggaggaagctgagcaatttcgggagttgggcctgccacccatgcctagcgtaggagcccttccgctttttctgggcatctcccccaagacgatttttagcatacgtcactctcctaagaaacactaccgttccttccctctgaccaagaaggatggcactaaaagggacatcgatacacctcgaacctacctgaaggtgatccagtggtggatcctggacaacattcttaatcacgtgccaattgcggagaatgttttcggctttgtcgctggcaggtcagcaccacagaatgcggagtatcatttcggagccaagcatgtcttaaacgtggatattaggcagttctttccatccattacaatcgaccaagtgcaggaaatcttcagtagccttggttacgaggaaaacgtggcaggcatgttgtctgaactgtgctgtctggatggcagagttccgcaaggggcacccacttctcccgccatagccaacctcgttctgagaaaagttgataccgacctaagcgctctttctacccaggccggtcatcgatattcacggtacgccgatgacctcaccttttccagccaatcgtggattgacagaaactttctgaacagcgtgcagaaaatcgttgaaggcgcagggttcgaactgaaacctgaaaaaacacgcttcagtggatccgagggtagaatggaagtaacgggggtagtgatcaatgaaaagctccagcccaccagggtgtggcgcaaaaggactcgcgccaagctgcaccggctctcactctcggtcagactcacacgccgggagattagttatctgcacggtgtgatcggaatcgccggacaattccccaagtctactcagatgcagcagctgagtgaatcagccaggattgtcatcgaacagaagtctcagacagtcatagggatcgggaatagacccaccttgccaaaccgcttgactattaagcaagctgaggccctggcagctttagcacctgggcggactaatagcgagatagcgttgcgactagagacaaccgaggtggccattaaaaagcgcctccaggaagctttccgtaaagtcggggtgtttgagcggaatcaggcattcaaatgggctcagacgaacttatga

SEQ ID NO: 14224 - RNA, 1224 nt, unidentified
  source 1..1224: mol_type = other RNA; note = synthetic construct
atgcctacacgttcatattattttcctaaggacttcgcacacctagaagaaattcttcgcgcggaaccaggcaacttcccagatgatgagacagcacgttttcgggagcttggcttaccacccatccccactactggcgcacttccactgtttcttggcatctcaccgaaaacgatatttagcattaggagacgccctcgcaaacactaccggtccttcccgctgaaaaagaaagacggaacaaagagggacattgatacaccacgcacttacttgaaggtcatccagtggtggatcttggacaatattctcaaccatgtggagatcgccgaaaacgtgttcgggttcgtggctggacggagtgcagttcagaatgccaagtatcacctcggcgccaaacacgtgctcaacgtggatataagacaattctttccttccatcaccatcgatcaggtccgggaaattttcgtcagccttgggtacaaggaagatgttgccgagatgttggctgaactgtgctgtctggacgaccgtgtacctcagggagctcccaccagtcccgccatcgcaaacctggtgctaagagggttagatgagcaactgagccgcctggccgacgaagctggtcatcggtactcgagatatgcagatgacctgaccttcagctctcagcagaggatagagcccgcctttctggactctgtgcagcaggaggtcgagcaggcaggatttgagctcaaaccggagaaaactcggttctccggattcgaaggccgaatggaagtaacaggggtcgttattaatgataagatgcagccctcaagggtgtggaggaaaaggacccgagccaagctccatagatttagccaggctactaggctcacacgaagagaattggcttacctgcagggcatcctgggtatggctgcgcaatttcctgagtcaatacagatgctcaagctgagcaaagacgccgccgggctgattgaggcgaagagtcacaccgtggtaggacgcggggagtcccctgtgttaccatctggcttgactctcagacaagccgaggttctggcgcagcttgcccccaaacggaccaatatcgaaatcgctatgcgcctgggtaccacggagtctgctgtcaagaagcgactgcaaggtgccttcaggaagattgacgtgaccgaacggcatacggcagagagatgggcctccgagaatctatga

SEQ ID NO: 14225 - RNA, 1182 nt, unidentified
  source 1..1182: mol_type = other RNA; note = synthetic construct
atggaacaaatactgtgggcggaacaggatgggttctccgaagagcaggccatgcattttaggaatcttgggcttccacctattcctaccgtcggcagccttccactcttcctgggcatttctcccaagaccatcttctcaatcaggggtaaacccagaaaacattaccgcagtttccccattcgtaaaaaagacgggaccccacggtatatcgacacccctcgcacatatttgaaggtgattcagtggtggatcttggacaacatcctgaaccacgtgcaaatagcggataacgtctttggctttgtttccggaaggagcgctgtccagaacgctgagtttcacctgggcgcagctcatatgctcaacatcgacattgagcagttcttcccgtctatcacaatagaccagatccgcgccatttatggtagtctgggatacggcgccgaggtggcaaatttgctagcggagctgtgctgtctggatgaccgggtacctcaaggcgcgccaacgagtccagccttagccaatctggtcttacgtgatctggataaagagctgtctcggctggctctccagaccggccacaaatactcccgctacgccgacgatctgactttcagcagtagccacagaatcgaaacagagttcctcgacgcagtccaaacggcagttgaacaggagggcttcaacttgaagccggggaaaaccaggttttcaggtctgggaggtcgcatggaggtgaccggagtggtgattaatgagaagacccagccatcccgcgtgtggagaagacggacgagggcaacacttcataagctagggaattctccccggctgacccgtaagaatgtgagctatctcctgggcataaagggaatggctaagcaatttcagaactccccccagatgcagcgattttcgctcgacgttgaacagctcctcgaagccaagtcacaaactgtgatcgggaaagggacaaggcctattctgcctaacagactcacaatcaggcaggctgaaactctggctgcccttgcccccagacgaactaatatggaaattgcaatgcggcttgagacaactgaagctgccgtgaagaagagattacaggaggcatttaagaaaatcggagtagttgatcgaactgaggccttgaactgggccactcacaatctatga

SEQ ID NO: 14226 - RNA, 1224 nt, unidentified
  source 1..1224: mol_type = other RNA; note = synthetic construct
atgcccaccagaagttattattttcctgacgattttcagcatcttgaaagaatcttgtttgaggagtacggcaataaatacgaggacgaactgagcttttatcgcaagaggcgaatccccccaatcaccaataccgggatttttccaattttcatggggatcagccctaagatcattttctctattctcaagaggccagagaaatactatcggtccttctccatacagaagaaggataagacaaaacgtctgatagataccccgcgcacttacctcaaggtgatacagtggtggattctcgacaacattctgaatcatatcgatgttgcccctaatgtttttggatttgtgatcggtcggaatgtcttccagaatgcagaatttcacctgggcgcgaagcacatcttaaacgtggacataaaacagttcttcccttccattaccaacgaacaggtcaaaaacatattttcctctgcaggctacaaagaagacgttgctgatatgctgacatgtctatgctgctacaaggggagagtaccccaaggagcacccacatcgcctgcccttgccaacttagtactgaggcaacttgataagtctctgagctctattgctgaggagaacaatttcaaatactcccgttacgccgacgatctgacgtttagcagcctagaacaaataaatgtgaactttctgaacgacgtgaaggagatcatcgagcgggagggatttaacctcaaaccagagaaaactcgcttcgtgggttcagggggcaggatggagatcaccggcatcgtgatcaacaagaagatgcagccggaccggatatggcgtaagaagacgagggcaacactgcaccaattcaagtataagacacggctgaccaggagagatatctcatatctgttcggtattaagggagtcactaaacagttccctgactcaccacagatgcagttgttcctcaaagaagctgacaacatcattcaggaaaagagtgaaacaatcatcgggcggagcaataatcccattctcccacatggcttgactcttagacaggctcaggtcttagtggagctgcgcccccagattaaaaatattgaaatcgccaagcgactcaacatttcagaggccgctgtcaagaaacgactgcaagaggccttcaaaaaaattggagtgactaaccgcagagatgccgaaatctgggcgaaaagtaatttgtga

SEQ ID NO: 14227 - RNA, 1224 nt, unidentified
  source 1..1224: mol_type = other RNA; note = synthetic construct
atgcccaccaggtcctacttcttccccccggacttcagtcatctcgaggagattctcagagctgagccggagggactgcccgatgatttgcagaactactttcggggaaagagtattcctcctattccttcggaggccgcccttcctcggttcctgggaatctcaccaaagacaatctttagcatccggagaaacaaagaaaagcactaccgcgtttttggtattaccaagagggatggtacacggcgtgaaatccagacacctcggacttatttgaaagttatccagtggtggctgcttgataatatcctcgacaatgccaaagtcgccgataacgtgtttggcttcgtggcaggtcgttccgccattaagaatgcacagtatcattacggggcgaatcacatcctgaatgtggatatccaacactttttccccagcatcacgcaggcacaggtcgtgtccgtatttgaagaaatcggatacgggaaagacgtaagcaggtatctcgctgaactgtgctgttttcgcgagagagtgccacaaggggcaccgacatctccagctatagctaatctcgtgcttgcagctctggacaaggaactcacaatcattgccgagaacgctaattgtcgatattctcgatatgccgatgacttgtccttctcatctactgaactgatagatgcccggttccttaacgagatcactaacgccgtcgcccaggccgggtttacccttaaaaaaaccaagactaggttcgcgggcaagggcgagaggatggaggtgaccggcgtggtgattaacgaggtcatccagccaacaagggactggaggaaaaaagtacgcgcgaagttgcaccgactatcagccatttctcgcctggtgagagccgacgtcaactttttatacggcataagagggatggcggcgcagttccctgaaagtccacagatgaccgctctggccagcaaggccgaagagttatgcagaagcagagctcatacggttattggccacggacccaacccactcttacccaacggcctgaccttgtcccaggctgaagtgctagcaaatctgcggccccgcaatactaattacgacatagctatcaaactgggtagcagtgaggcagttataaagaaaaggctgcaagaggcattccgcaagattgggtcagccgaccgtacccaagcagaacgatgggctaaggagaacctgtga

SEQ ID NO: 14228 - RNA, 1224 nt, unidentified
  source 1..1224: mol_type = other RNA; note = synthetic construct
atgcccacccgctcttattactttccgcaggactttaaacacttagaagaaatccttagggccgaaccagacggcctcccagatgaggtgtgtgagcattttcgggcgcgaggactgcctcctattacatccgaaggggcattaccacgatttcttggaatatcccccaaaactatctacagtatccggcttaactcccgcaagcactacaggaaattcgatctgaaaaagcgggatgggacagtgcgcgaaattcatagtcccaggacctatctcaaggttatccagtggtggctgctcgataacttgctcaatagggtaaagttggcggacaacgtgttcggcttcgttagtgggcgcagcgccgtgcagaatgctgagtaccataaaggcagcactcaccttctgaacgtcgatatccagcagttcttcccctcaataacccaagaacaggttgaggacattttcggccggttgggatatggtccggccgtagctaaaatgctggcagacctgtgctgcatgaatagacgagtcccacagggagctcctacttcacccgctctggccaacctggtgcttgaagatctagacaaagccttggccgacctcgccgcacgtttcggatgtcgctacagcaggtatgccgacgatctcactttttctagccatgtccggattgatgaggcgctgttagtggaagtgaccgcaaccgttcagaaggctggcttccagctgaaggaggctaagacaaggtttgccggctgcggtgaccgtatggaggtgaccggagtggtaatcaatgacgtcctccagccccctagagattggaggaagaagaccagagcaacactccacaagatggggtcacgcggccgcctcacaagagctgatatttattacttgtacggcatacgggggatggcggcacagtatgaggcctcgcagcacatgcaagcactgagagtggctgccgagggcctaatgaaggctaagtctcacactgtcattgggtttggggcgaagccttctctgcctaatggtttgacgctgcggcaagcagaggctctggctgagctgggaccacgaagaacgaattccgagatcgcagctaaactggaaaccacagaggccgccatcaaaaagaggcttcaagaggcctaccgtaaactgggtgtggccgacagagcagaagccgaaagatgggccaagaaaaacctatga

SEQ ID NO: 14229 - RNA, 1224 nt, unidentified
  source 1..1224: mol_type = other RNA; note = synthetic construct
atgcccaccagaagttactactttccaaagaactttacacatctcgaggctattctgcgagccgaacctgacggattcccagacgagcaggctattcgctttagggatctcggcctgcctcctatccccacagctgggacactgccaatcttcctcggcatcagccccaaaatcatttttagtatccggcggaggcctagacgccactataggtcttttagcctgatcaagaaggacggcacggagcgcaccattgacacccctagaacatatttgaaggtgatacagtggtggatcctggacaatatcaccagccaggtcgagatctccagaaatgcctttggttttgtgagagggcggagtgccgttcaaaatgccgggcatcacctgggcgcccagcacattttgaatgtggatatacgacagtttttcccatctgtgaagatcgcacaagtcttcgagattttcatgtccataggttacaacgaggaagtcgctgagatgctttccgaactctgttgcatcgacggtcacctaccacaaggggcccccacgtcaccttccattgctaacttaatcctcagggacctggatgagaatctgtgtaacctcgccgaccggagtggttgcttgtatagcaggtatgcagatgacctgactttcagcagtcattcaagaatcaacgataatttcttggagtctgtgcgcaaggaggttgaaaactcaggattcaaactaaaatcggaaaaaacccgtttctctggacggggcgatcgcatggaggtgactggcgtggttattaatgagaaacttcagcccccgagggactggagaaagctaacccgagccaagttacataaactggatagctccaatcggcttactcgaaggcaacttagctacctccagggcgtaatgggaatggccccgcaattcccggattcaccacagatccagcagttgtccgaaaaggctcgtttaattgccgaacagaaactgcacactataattgggcacggccccaggcctatcctgcaaaacgggctctccctgagagaatcagaggcacttgcagcactggtcccctctaaaacaaacctggaggtcgcgattcagattggaattaacgaggtagtgctggaaaagcggctggaacgtgcttacaaaaagataggagcagaaaaccgccagcaggcgatctcttgggcggatcagaatctttga

SEQ ID NO: 14230 - RNA, 1224 nt, unidentified
  source 1..1224: mol_type = other RNA; note = synthetic construct
atgcctactcgcagttactactttccgtctgatttcaggcatcttgatgaaattatcaagttagaggttgacggccttagtagcgcagatctggatcactttcgaaacctgaatatgccccccctgcttagagccgggaccattgccatatttctggggatttcccccaagaccatttatagcataagacggaaccagagtaagcattatcggagtttctgcatgaagaaatcagacggctcactccgtaacattgatacgccaaggacctatctgaaagtcgtgcagtggtggatcctagacaatatcctgaacaaggtcgttttcaacagcaacatcttcggatttgtgccaggaaggtcagcaatccagaatgcccaataccacatgggcgcccagcatctcttgaatgtcgacatccaagattttttcccgtccatttccattgaacgggtgagagccatctttagtactctcggcttcaatgaggaggtagcaacagtgctgagcgagctgtgttgcctgcacgatagactgccacagggagcccctacttcccctgcaatcgccaatctcgtgctgcgagacttagattctgacctaagccggatagccgaggcagagtggtataaatactctcgctatgccgacgatttaactttctcttccatgacaaaaatcgaagataccttcctggaccaggtgtacgaagcggtgaacagggcggggttcgctctgaagcccgctaagacaaggttttcaggtcgtggcggtcgcatggaggtaaccggggtcgtgatcaacgagaaacttcagccctctagggattggcgtaaaacgactagaagcaagcttcaccgactgagagacgctgctcggctgacccgcaaggaagtggcgttcttgttcggaattaagggaatgagcgtgcagtttccagactcccctcagatgcagtcattggcatttgaagctgagaatatcctcaagcagaaatcccacacagtcatagggcgcggtaagcaacccgtcttgccttcgggcctgactctaagacaagccgaagtactcattaagcttaggccacataagaccaatgctgagctggcctacgagctcggcacaaccgaagctgctgtgaaaaagcggttgcaggaggtgtttaaaaaagtttctgttacagaccgcatcgaggccaaacaatgggcagacgaaaacctctga

SEQ ID NO: 14231 - RNA, 1038 nt, unidentified
  source 1..1038: mol_type = other RNA; note = synthetic construct
atgccgactaggagctactatttccctaccgaattctcacacgtcgaacagataatccgagccgagtccacggcagacagggaaacaagcttcgctgagtttcggcacttaaatattgcccctatcttctcggggtatgagctggcgaatatactcggcatcggcccaggtcttctcattggcatactgaggaacccccaccagaattatcgacagtttcctgtggtgaagaaaggagggggaacgagacaagtctcatctccccgcacttacctaaaggtcattcagtggtggattctggacaacattctgactcatctggaaacacctgatatcgtgtttggtttcaagcgaggaacctctatcaattggaacgctcggcatcatctgggctcacgccacttcctgaacgtggacattgccagcttctttgatagtgtcaccgaagtatccgtttacgacttgttttctcggctggggtatgccgactccgtgtccagcgtactctgccaattatgctgtctcaatggatcccttccacagggcgctccaaccagtcctgctatcggcaatcagatcctaaagccccttgataactcattatgtgagctgagttctgagcacggcattaagtattccaggtacgcagacgatttgaccttctctagccgggattttatagcccaagacttccttgatgccgtgagactgcgcgtcgccgagatcggatttgagctcaaggacgagaaaacaagatggcgggggccaggcgctcgtacagaagtgactgggttggtggttaccgacttcgtgcagccgcccttgaaatggagaaaacagtgccgcgctactctgcatcacctcgggaaaaaggaaaggctggagcaaaaggacatcagatacctcgaaggtatcctgggatacgcaagtagcttcgaggatgcaaggcagatgcaggcattgaaggccacaaccgcgagactgcttgaagagcatcgctttccctttacagaggttgatcgtaaaaacacccggtga

SEQ ID NO: 14232 - RNA, 1020 nt, unidentified
  source 1..1020: mol_type = other RNA; note = synthetic construct
atgcccacccggagttatttcttcccacctgactttcagcatatagaagccatattgaggtccgacgatccgatggcggatgagcttcagtttgagaagtttcgtgagcgcggagtggctccactcctgactgagttcgacatcgcaacagtactggggattggtcccaagttgatcgtgagcatgctgaagaaacccaatagacactaccgtacgtttccactgactaaaaaggacggcagtgaaaggcaaatttcagctccccgaacatacttaaaggtcgcacagtggtggattctggacaatattgtgtctagagttcctgcaagtgaaaacgtgtttggcttctgccgcgggagatcaattcaagataacgctcgataccaccttgggagcacacatatcctgaatgtggacatcaaatccttcttcgacagcgtaaccttctctcaggtgctactcgtcttcaaagaactgggttactcacagccagcagccaaaacgctggctggactgtgtactctgaatggcaagctgccacaaggagcgcctacctcccctaacattgcaaatatggtcctttcaaaagtggatcgggagctcgaagcactcgcctcctctgtgggctccaagtatagccggtatgccgatgatatcacctttagcgctgatgattacatcagtgagcagttccaggtgagggtggaggacgtcgtaaagtctgcggggtttgagttaaaagccagcaaaacccggtacgccggtactggatcgagaagggaggtgacagggctaatctgcggcaccttcgtccaacctccgatagagtggcgcaaactcaacagagctcgcttgcacaacttgggcaaaaagccagttctggaaaagtccgacatcgcctatttacttggccttaggggttattctatgcagtttcctgatgccgttcagatgcaggccctcttggctggagccgacaagctgctcctgagcacaaagaagcccgttcccgaaacttga

SEQ ID NO: 14233 - RNA, 1005 nt, unidentified
  source 1..1005: mol_type = other RNA; note = synthetic construct
atgccaagccgttcttttttcttaccacccgatcaactggcaaacgctgcagtattagcggaggccaatcctcccgagaggcatgacgagatcatgcggttggccagccgaggaattgcacctcttgtggacgaggtttccctcgcggagctggtgggtgttacacccagtttgatcttctctatactcattcgcaaggataaacactacaggtctttctgtctaccaaaagctaatggtagcacccgcatcataaactcccctcgaacatatttgaaggtgattcactggttcattctggacaacatcctgtcaaaggtgaagaacaacgactgcgtcactgcatttatctcagggcgcggaccgtacttcaacgcccaaatgcatagcggtgcgcaccatatctttcagaccgatctcgaagagttctttccatccataaaagtgcagaacgtgtatcggatgtggctgtcaatcggctacaatcaggaagtggccgagcagctgagcaatcttgtgacatatagaggcgaactgcctcaaggcgccccaacgtcacctgctatctccaacattgtcgccgggaacctggataagagactactcaaactcgcctatgagtacggctacaagtacactagatacgctgacgacattactttcagtagcaaagagaggattccccttgaatttgccgacgccgtcaatgaacagatcgtcttggggggcttcatcgagagtaggaggaagcgccggttcaaaggctttggtgcagctatgaatgtaaccgggctcaatataaacgattttccgcagcccccacgggaatggcgtaagagaacccgagccctgttccacagagcaaagttagatgccgcctttgctaaagaaaaccggggcaaaatcgcggggtcccttggagttctgcatgcagctggactgccctctcagcaccctctgattcttaatggaaaggaagctctgctcaattcgaagaattattga

SEQ ID NO: 14234 - RNA, 1035 nt, unidentified
  source 1..1035: mol_type = other RNA; note = synthetic construct
atgccaccgcgatcatattacaatgagcctcgtccctctgactatgtcgcctttgcgaaagcctttttccccgatgaattgcaggcagctagtgagttcgccgaaacaagaggactcccctatatcaactcttccgcacacatagccgcgtacttaggtgtgagtgccagcctgctgaggcaggtgattcataagcctgcatatcattaccgagagttccccattaaaaaagcatccggggccgataggattgtctccactcctaagacctatttgaaggtaatccagtggtggattgccgataatatcctgaacaagatacaactgtccgacagcgtccacggattcagacggggcaagtcatacttcacaaatgcaagcgttcatttaaatagcaagcacattctaaacgttgacgtggagagttttttcgactccatcacatttgcccagatcaccaatgtcttcaactcacttgggtacaccgaagcgggctcactgacactcgctactctgacatccaaaaacggtatagctcccacgggtgccccgaccagtcctatgattgccaacgctatcctgcgctctctcgacagccacttggaggcttttgctgcgaaatctaatctgctatacactaggtacgccgatgatctgaccttttcgtctccagaatggattgaccagagtgttgtagacgcagttaccaagtatgtggagtcccaaggcttcaaactcaacgctaagaaaaccaaatttatgggcccaggggatcggatggaggtcactgggctggtgacgaatgctggacttaacgccagcaaggagtggcgcaattgggcaaggggcttcctccaccgtgtgtcacgggagcctgccaagcatatcggcgaaatcgaacgggtgagaggagtatacggagtgttgagacagctggatccagaaaagcacaagaaactcactgtggccgctgagcaggcaatggggcatcttgcagacgtgaaacgcgcccttgctggctctaagcaaagctga

SEQ ID NO: 14235 - RNA, 1026 nt, unidentified
  source 1..1026: mol_type = other RNA; note = synthetic construct
atgccccctagaagctattacaacgcaccccggcccagcgattacgtggcctttgcaacagcatttttccccgaggacagcgacaatgcagggaaatttgctgaccagttcgggctcccgtacctggagtccaccagacatctcgctggataccttggaatcgccccctctctgataaggcagatcattcaccggccggcgtatcactttcgggaatttaaactgaccaagagtactggcgaggagcgattaattagtaccccaaagacttatctcaaggtcatccagtggtggatagccgataacatcctcgataagattgacttgtccgacaacgttcatggcttcaggaaaaacaggtcttacatttccaacgccataattcaccgggattcccgtcacattttgaatgtagatgtgaagtctttcttctcgaatatcaagatcgacaacatcttcaatgtgttcagcgcacttggctacggtgacgctgggagtttactgctgtcaacactaacctccaaagatggaatggctcctaccggcgcccctacttcaccaatgattgctaatgccgtctttagggacatagacactcagctgtcaaaattctcccagcaaatgggtctgctatatacaagatacgctgatgaccttaccttcagcagcatggagtggatcgagcatgatgttttggaagccgtgtcacagatcgtagaatcaggtggctttaaccttaatagcgcaaaaacgaagttcatgggaccaggcgataggaaagaagtgactggggtgacagtcaacgccgggctgaatacctctaaggaatggcgcaacagtgtgcgcggctatctccacagagcgttttctaatccagccgactatatcgccgatgctgccaaggttcgcggtatttacggaatcctgctccagtttgaccctacaaaggccaagcgtctgacacaaacggcagagcagaccatgctgcgactgttgaaagcgcaacgcgatagtgcttcctcttga

SEQ ID NO: 14236 - RNA, 1035 nt, unidentified
  source 1..1035: mol_type = other RNA; note = synthetic construct
atgcccccgcggtcttattacaactcacctagagcgtccgactacatagcctttgccagggcctatttccctgatgagcaagaacaggctaactccttcgtgaatacatataacctaccttacatcagcagctcccaccacatcgctgcctacttgggcatctcaagcgcgctggtgagacagatcatgcacaatcccaattaccattatagggttttcccgatccagaaaagctccggcgatccacggatgatttctactcccaaaacctacctaaaggtgatgcaatggtggattaacgataacattctcaacaagattcagctgagtgaatccgtccacgggtttaggaagggaaagtcatacattactaacgcccgcgttcactttggagcccggcatatcctgaacgtggacatcaagagcttctttgataatatcacaaccccccaaattgcaaacgtattttccagtatagggtactgcgaaagcggaagtttaactttagcagcccttacttcaaaacagggtaaagctcctaccggtgcaccaacttctcctatgattgccaatgctatcttcctgaaggcagacgaacagctgatagagttcgctaggtctaaaggcctgcgttatacccgatacgccgatgacctcacattctcaagcgatcatcgcatcgacgaggaggtggtgggcaaggttaacgccattgtcaaaagctcgggttttcagctcaatgacaagaagaccaaattcatgggcccaggcgatcgtcaggaagtcaccgggatcatcattaatgagagaatgaacttgtctaaggagtggcgaaattttgcaagagggtatatccacagtatactgtcgaacccctccggaaatattcaagaaatgggacggcttctcggcatatatggggtgctgctgcaggtagaccagaacaaagagagtaatcttacgaagaatgcttacaaagcgatccgcattttgaaggacacggagcagacaaccacacatgctgagccatcttga

SEQ ID NO: 14237 - RNA, 1017 nt, unidentified
  source 1..1017: mol_type = other RNA; note = synthetic construct
atgccacccagaagttactacaaagaacctagagtttcagactatattgcctttgcagatgcttatttccccgaagaaaggaacttggcggccgaatttgccgagcgcacccgtctgccctacgtagagtcgtctaagcacctggctgcatatgtcggagtatcaccttccctcctgaggcagatcatgcacaaacccagttaccattacagggaatttcccctgcacaaagctgatgggagcgagcgaaaaatcagtacacctaagacctatctgaaagtcgtgcaatggtgggtcctcgataatatcctcgctcgccaggcacttgacgaatgcgtgcatgggtttcgcagcggtcgcagctatgtcacgaatgcgagagtgcaccaaaactctcggcatatcctgaatgtggacataaagtcctttttcgacagcattaagatgtcccaggtggccaatgtgttcctgagcctcggatactctgaggccgggtccctgacactgacagctctgaccacgaaggacggagtagcgccaactggcgcaccaaccagtcctatgattgccaacctgatcttccgtgacgctgacttggcccttgccgagttcgcagaggccaacggtcttatatactcccgatacgcggatgatctaactttctcaggccagcatcggatccccgacgaagccgttgctaagattgctgaaatagtgaatgccgcaggttttgagcttaacatcaagaagaccaagtttatggggccgggcgataggcaggatgtgactggcgtggtggtcaattcaggcttaaatgcaccacgggagtggcggaactgggcacgaggatatctccaccgggtgcggctaaacccggataagtctgccgaagagctcgggagagttaggggagtttacggcattctgagacagttcgaccctgagaggaccaaaagcttgactagagccgctttcgagacattagaggccttgaaacagtatcgcacagagccatga

SEQ ID NO: 14238 - RNA, 1008 nt, unidentified
  source 1..1008: mol_type = other RNA; note = synthetic construct
atgcctccccggagctactatgttgactcccgcatttccgattatatcgctttcgcaagcgcatactttccggaggaaaaagcccttgccgtggagttcgccgagaggaccggtctgccttacatcgagtcgtcaatgcacgtggccgcttaccttggcgtgtctccatctttgatccgtcagattatgcacaaaccaagctatcactaccgggagttcacgctgaagaaaaccgacggtggcgaacgaaagatctccacacccaaaacatatttaaaggtcgtgcaatggtggatactggataacattttggctcggcagccgttaggcgaatgcgtgcatggatttcgcagcggccgcagctatgtgaccaacgctcagacacacgagaagagtcgccatatcctcaatgttgacattaagtctttcttcgactcaataaagatcagtcaggtgtccaacgtttttgcctccctcggctattccgagtctggatctctcgctcttactgccctaacaaccattgacgggatcgcccccacaggagctcctacaagtcccatgattgccaacctcattttccgggatgccgacgtcagtctggtggcatttgcacaagctaacgggctgatctatactagatacgcagacgatctgacttttagcgcccagcacaggatagcagaggaaatcgtcgatcagatcgcggaaatagtggatgcggccggcttcagactcaatactaagaaaaccaagttcatgggtcctggggacaggaaagacgtaaccggcgtcgtagttaattcacggctaaacgctccacgagaatggaggaattgggctcgtggatacttgcatagaattagactgaatccaacggagaacgccggggaagtgaggcgagtcagaggaatttacgggaccctgagacaatttgatcccgagcatgcgacttcactgactaggatcgccctgcagacccttaatgtactgaagcaggcacgctga

SEQ ID NO: 14239 - RNA, 1095 nt, unidentified
  source 1..1095: mol_type = other RNA; note = synthetic construct
atggcggcactgcaaccacgggctgaatttagctccgcgtcttacaaggcaagaactaagcagagtcaggactggtgctgtagaatgccccccagaagctactacaatagtccgcgcatcgatgattatttagcatttgccagagcctcattccctgaggagtctgaggctgcaggggccttcgccaaccgaactgggcgaccttacctggagaacgagattcatctggccagctatcttgggatttccccatccatcattcgacaaattttgcaccgtcctaggtttcactatcggacctttattctcaaaaaagctgatggcaccaaccgtattatacggacaccaaaaacctatctcaaggtgatgcagtggtggataaacgacaacatactgatcaccaaggagatggcggaagccgtccacgggtttcgcaaaggaaggagctatattacaaacgcagctgcccacgctggtgcgaaacatctgctaaatctggatatcagccgcttcttcccctcaattaccgctcagatgatcgttggcgtgtttcggaatctaggatactctgccgcgggctccgatttcctcgccagactgacttctcttgatgatgaggcacccactggggcaccaacaagtcctctcatcggtaatctgatccttgacaacttcgaccagacagtttcagaactgtcggctgcacgcaacatcacgtatacacgctacgccgacgatctgacattcagtgccagaacgaggattgacaatgagtttttaaaggaagtgaccgccttcgtggaaagctcaggttttgatctcaatccgaagaaaactcggttcctgggtaagggagacaggatggacgtgaccggcgtagtcataaatgaaggcctgaacttgcccgtggagtggaggaactgggctaggggctaccttcagcgcgccatcaggaatccagtcgagtttgttcagcaccatcctgccatcgcaggcatcttcggagtattgaagtctatcgaccccgacgaacaaagacatctcactcagaaagccaagtccgctttgaccgccatacggtccgctggagcttga

SEQ ID NO: 14240 - RNA, 1011 nt, unidentified
  source 1..1011: mol_type = other RNA; note = synthetic construct
atgcctccgcgctcttactacaacagcccccgcgtggacgattatctggctctggctcgcgccttctttgcagaggacgctgacgcagcagccgcctttgccgaggtggaaaggaggccctatattgagtctgaaacacacctcgccagttacttaggcatctcaccaagcatcatccggcagatcctcaggcatccgaaatttcactacagaacctttaagcttaagaaggcagacggaaccaatcggattatttgtacccctagaacttaccttaaagttatacagtggtggatctccgataatatactgtacacagagcagccagatgtgtcggtacatgggttctgcaagggaaggtcctatatcactaatgccagcgcgcattccggcgcaaagcacctgctgaaccttgacataagaaagttcttcccttccattacggaagaaatgatagtcggcgttttcaggacactggggtatagtccagccggtgcgtcattgctcgcacgactgaccagtctcaacggcgaagcgcctactggagcccccacttcacccgctatcggaaacctggtgctggccgaattcgataaagctgtgtctgccgcggccaccgctaacaacatcctctacacaagatatgccgatgatctgaccttcagctctcagaatcggatcaacgaggactttttagccacaatttccaccctagtccagtccagtggctttgagcttaacctgaagaaaactaggtttctggggcgaggggccagaatggacgtaacgggtttggttatcaatcagggtttaaatctcccaattgagtggcgtaattgggcacgaggatatctacaacgggtggtgcgcaatcccgccgctttcattgaccaccgttcaaccatcgctgggattttgggcgtcctcaaaagcatcgaccctactgaggatcggggcttgacacagaaagctaagtctgctctgcgcgcaattcaagagcaagcaagctga

SEQ ID NO: 14241 - RNA, 1017 nt, unidentified
  source 1..1017: mol_type = other RNA; note = synthetic construct
atgcccccaaggagttactatatcgaacctaaacagtcagattacctggccattgccaaagcattttttcctgaggagctgaatgacgccagagactttgtcgagcaaacagggctgccatatctgaaaacttccgcacacgtcagcagctatctgggcgtgtcccccaaactggtgcgccagatattacacaagccgtcataccactatagatttttcgagattcctaagtctgatggctccctccgagcaatcaccacacctaaaacttatctgaaggtcgttcagtggtggatctgcgataatatcctcaatcaaatgccactccatgactgtgtgcacggattccgttccggccggtcttatctcacgaacgctaaagcccacttcggccagaagcactttttaaacgtcgacatcgagagcttcttccccagtattggggcagaccttgtggaagctaccttcctagagatgggataccatagcgacggagcctcagtgttgagggatctggttacccttggtggagctgctccaactgggtcgcccacgagtccgatgattggtaatctggttctggccaagtttgacgctctccttacagaatacgtggcggatagagggttcgtgtacacacggtacgcagacgacatcaccatctctagcaagcactggatagatgatgaggttctgggggatatttccgcattggtgcagaagtttggcttccggctcaacgagaggaaaaccaagttcatgggacccggcgaccgacaggaagtaaccggtattgtattaaactcatctcccaatatacctcgcaactggtgcaacagcgtgagaggttacctgcatagggtcaaattggcccctcacaagcatgtggacgagcatgccaaagtgcagggcattctaggaactctgttggccgcggatccagaagctgaacgtaagatcacaaaggctgcgcgcgaggccgcccatcttgtaatgctggaacggctcatgcaatga

SEQ ID NO: 14242 - RNA, 1002 nt, unidentified
  source 1..1002: mol_type = other RNA; note = synthetic construct
atgccccccaggtcctattatctcgagccgcagaagacagattaccttgcattcgcaaaagcatacctctctgatgaatatggaatagctaaagcctttatagacgagaaaggcctcccatacatacgcaacgctgaccatctggccgcctacctgggtgtgagtccctccctggtgcgccaaattttgcacaagaaggaataccactatcgtcaatttcctctacctaaggcggacggaccacccagactgatctccacgccaaaaacttatttgaagaccatccagtggtggatcggcgataacattctcagtcatgttgcgctgggggacgaggtgcatggctttcggcagggacattcctacgtgaccaacgctagagttcaccttgggtgcaatcacattctgaacatggacatcgaacagttctttcccagcattacaaaacccatgacgactagcgtctttacatcactgggctatgggaaggaaggggctggggtgttggccgagttatgtacacttgatggcagcactccaactggcgctcccacctcgcctgcaatcggcaacatggtcttggtggacttcgacagagccatgacaaagctggccggggaaaataccttaaaatatacgaggtacgccgacgatctcaccttctcttcaaacgaatggatcagtccagaattcgctctgcaggtggaggaggtcctgaaggggtacggattcgcgccaaaaggtaccaagacaaagttcatgggtcgaagcgataggatggagattaccggcgtaactatcaatgagggtaccaatccgcctcgagaatggaggaattgggctagaggatttctccatcgggcacggatgaatcctcaccagtacgcccacgagtggaagaagatcgccggcatttacggaacattaaaatcaatggaccctgatgaggataaactactgactaagcgggccaaacaggttctgaaccttgtacgctcttga

SEQ ID NO: 14243 - RNA, 1035 nt, unidentified
  source 1..1035: mol_type = other RNA; note = synthetic construct
atgcctcctagatcctattaccattcaccacgacactccgattacctcgcatattttacagcctatttcccaaatgagttgcaagtgtgcagagcatttctggaagcaaccaactatccctatatcgggaatatccatcacttagcggcttacattggcgtttcaagcgctctcctcaaaaaaatcataagcaatgtcaactaccactacagtgacttcacaattcccaaaggtggaggaaaagagcgcgtaatttactctccaaaaacttacttgaaggtaatccagtggtggatctgcgacaacatcttctccaacctgaagtttaatgagtctgtgtacgggttcgtcaagggtcggaactacatagacaacgccaaaaaacattttggaaggaaatacatcctgaacgtggatgttaagaactttttcgattccattagcactgaggatgtgaaaaagattttcctgaagttgggctatccaatttcatcttccgaaatcttaagcaagctgtgtaccctggacaatcggctccctactggagctccgacaagtccggtgatcgccaatctgtatttcaaggatatcgacaacatccttgagctggagagtattaagaatgggtggatttacaccaggtacgccgacgatctaacgttctccgccaataccaagatcaactttgatttcttggaaacccttaagaacgtgctggacgaatatcaccttaagctgaacgacaaaaagaccaagtttatgggccctggcagccgtcaggagatcacaggcattgtggtcaattctgtcataggtatgcccaaatactggcggaataagactagaggatttttacacaacgtgaggaaagaccccagcaataacctggacaaaatacaggaagtgaagggcctttatggggttctgatctatctagatcccgagaagaatcgctcgataacgaagcaggcctatgaggtcctcgggattctcaaatcacataagaagcctctgcatgaaaccaaacacaagtga

SEQ ID NO: 14244 - RNA, 1017 nt, unidentified
  source 1..1017: mol_type = other RNA; note = synthetic construct
atgtctccccggacgtacgatttaatcaccaacccaaagtatatcgacttcatttccgagagtgtcaggtccggctgcagcctggaggatgtaaaatttccagtgcctagtgtgtccctgccagccctcaacaaagcagaagacatctcctactatcttgggatcagtcccgagctgatctggacgctcatacgctctccccggtacaagtacaatactttcagcgtgaggaaaaagtcaggaggtagccgcgtgatcagcgctccccgtacatacatgaaggttgtccagtggtggatcaacgacgtgattctctctaaatttcctcagcgcgataatgtgttcgggttcgttccgggggtgagttacgttgataatgccgcttaccaccacggcgcggtgacaatgatgaatgtggacatcaagaacttttttcctagcatcaagtcagaagatgtgcttgtatgtttcatgaagattggctattccaagcaggtcgcccttggactcagtgccttgaccacctatgcaggatttctacctcagggtgcacctacttctcccaacctttcaaatattgttttctccgagtttgacgagaaaatttcgaacatttgcaagctatacaacttaaagtactcacggtatgctgacgacatgaccttctcttccattggtagagtcccgaaagactttcatagaattatctcacgtgaactgttccctaagttcctcctgaacgatgaaaaaacccaatatatgggggctggggacaaaaaggaggtcactggcctggtcctgggaagagatggcccagccatctctagggagaaactgaatggcctccgaggctggttgcatcagataattgccaatccagagcaatatgtggatgatctggaccgattgagcggaacactggcaatggtaaggatggtgggcggacgagggacaggacccatactgttgcaaggcggtagagccatgcaggcgatagaacagagcctgcggatctga

SEQ ID NO: 14245 - RNA, 1797 nt, unidentified
  source 1..1797: mol_type = other RNA; note = synthetic construct
atgacattcccagcagacttccggagggtgacgaccagagaagcgctgataaccgctatcggcaccgacgaggccacttttgaagcgattttagcatttgaccccccacggacaagagaagaacagatcgaggcccttcaaagggccgctgatgccgcgtccattgaagatatcccggtattcctgagacatgacatcccgaagcggaacagacgtagaggacacagaacggtttgggagccactgctaggaaagcccggatatcgcacactcgctcggcggttggagacattttttaggatcgcccttcctgggtatcctcacgacgcagtgtacggctataggcctggaaggaacattcgcgaaaatgcctccgctcacgctggacgttccgcacttcttaatgcagatctggagaactttttccccagcattactaccgacagggtggccgctctcttcacaaagctaggactggtccctgacgtcgctgagctgttggcccgcttcgtgacgatcggtggtggactcccgctcgggttacccaccagtcccgtcatcagcaatgcagtcgccctgccattggaccttgcttgtgcagccctggcatcaggggcaaatgccacctacacccgatacgccgatgatctgacattctccggcgatgatcagctgccagcaatcgatgcgctgcgcagcgtggtagaagcccaagggttcgttctcgcagaagacaagactaggcgatcgaaaattgggcaggcgcattatgtgactggactctccatctctgaccccgcccaaccccacgtgccaagagagaggaagcggcgtctgcgccaggagctgtactacgccggaaaatttggcatcgctgatcacttccgccacagaggtgttaacgacgctcgagtgatccagcaggaggtcaaccgagtggacggccttgtcagattcgtggcccatcatgaacccgcgatggcccctcggttgcggactcaatggcggaaagccttacaggacgagggcatgaaaccaagttttgcacctcgcggtcagcatcgcgctcccttcttcatcttcgtggacgaggccgaatttgatcgcggggggcagaaggtactagcaattggtatggccgtctcacagcatggcccacgaatggccatagaggccgggcaggtacttgaagccgctttggcggatatgtatctggatggagatccagctgccctgcgtaagcgcggcttgcacttcgtcgacgccaccgaggatctgaggatagcctacgtgagaagactggagggcatgcggtttgagggctatgtggcttttgctgactgcgatgatccaagtagatatgaggaaacatatctccgactgctgggtgcaattattgaaaggaggctcaaagccgcggaatctcagttagccagcttttacatagagcagaatgagaaagtgagtgctcacagggtgaaaggcttaattcaggatgcttttgacagactaaaggcacgtgacgatcggcggcccgttgacttcgcagttcaattcgtgagcaagcctcacctcggcatctcagctccagactttctgctcgcagttctcggccgatacttgaagtcaaaggctgccaaacctgggaaaccggagcccagagatcgactgatgtttgagcggcttagggacaagtaccggctgatactcgatgtcactacctggactgaatactctcgcaggcgccctattctgccctggagcgaccagacccctccttctgacgacggggcttga

SEQ ID NO: 14246 - RNA, 1785 nt, unidentified
  source 1..1785: mol_type = other RNA; note = synthetic construct
atgacatttccagcagactttcggcgcgtcaccacacgggaagccctgatcaccgccattggcactgacgaggccaccttcgaggccatactcgccttcgatccaccacgtacccgcgaagagcagatcgaagcccttcagcgagctgcggacgctgcctcaatagaggatattccggtatttctgaggcacgacattcctaagcggaatcgccggaggggtcatagaaccgtgtgggaacccctattagggaaaccagggtaccggacactggctaggcgcctcgagacatttttccgcattgccctgcctggatatccgcacgacgcggtgtatggttatcgccccggaaggaacatcagggaaaatgcctccgcgcacgctgggagatccgcattactcaacgccgacctcgaaaatttttttcccagcattaccaccgaccgtgttgccgccctttttaccaaacttggcttggtgcccgatgtggccgagttgctcgctaggttcgtgacgattggtggaggcctacctctgggactgcccactagccctgtgatttccaatgccgtggcactgcctctggatctggcctgtgcagctcttgcgtcgggcgctaacgctacatatacgagatacgccgacgacttaacattcagcggcgacgaccaactccctgcaatcgatgctctgaggtccgtcgtggaagcccagggctttgtactggcggaggacaagactcggaggagtaagatcggtcaggcccactatgtaacaggattatctataagcgacccagctcagccacatgtgcctcgggaacgaaagcgtcggttgaggcaggagctgtactacgctggcaagtttgggatcgccgaccatttccgccaccggggagtgaacgatgcaagagtgatccagcaggaggtgaaccgggttgatggcctagttaggttcgtggcgcaccatgaaccagctatggcgccgcggctaagaactcagtggcgaaaggccctgcaagatgaagggatgaaaccctcattcgcgcccagaggccagcatcgagccccatttttcatatttgtcgacgaagcagaattcgatcggggggggcagaaggtccttgctatcggcatggcggtcagtcagcatggccccaggatggcaatcgaggcaggccaggtattggaggcagccctggccgatatgtacctggatggcgatcccgccgccctcaggaaaagaggcctgcactttgtcgacgcaaccgaagatctgcgcatcgcttacgtgagacgcctcgagggaatgcgcttcgagggatatgttgccttcgcagactgcgacgaccccagccgttatgaagagacgtacctgcggctgcttggagcaatcatcgagcgacgccttaaagcagcagagtctcagctggctagtttctacattgagcaaaatgagggcctgggagcccaaggtcagagggctgatccagggcggctcagaccttctcaaggggccaggcgtccaagcccaggtggattgagacgacctgtccgcctcgaggctgcatcaggcgaccagagggctgggttcagcgccagaagatcccgatccatatctcaggtggagtctggagaaactgggcaagccggtgcagctcgtcctgctgatgtgagagcactcgctaggcagatttcggcagatcccagacgccacgatgttgaccgagttttggccgctactagttacccttcattggtccggccggatcccgccgagagatga

SEQ ID NO: 14247 - RNA, 1770 nt, unidentified
  source 1..1770: mol_type = other RNA; note = synthetic construct
atggcgttcactccagactttagacgattgtccaacagggaagccgtgcggggagctctgggagtaagcgaggatgtcttccaggccgttcttaccttttcaccggaggcggtcgtgggcaaacccgaaatggagggagggttttacctcgcctccagcatcaccattcctgtcttctttcgccacgacattccgaaacgcaaccctgcccgcggggtaaggactgtgtgggaaccttctatcgaggtgaagagcgtgtataaagccctcgcccggagactggatctctttttcagggcacacttggatggttttccacatgatgctgcctatggattccgagttgggcgtaatatccgtgagaacgccgctcctcatgctggacatcggcatctcgtggccaccgacatagaggacttctttccatctataagtgtggacagaattcaggggctgttcaatgagctcggctgccggaaggatgctgctcaggccttggcccaatttgtgacgattggcggcgaactgcctgttggtttaccgaccagtccagtgatcagtaacgccgtggcactccctctggacagggacttagccgcgctggcagccacaacagggtcgacatatacccggtatgccgatgatatcgcactttcaggagatgtggagccaccttcttcagaggaaatcggccgcgtcctggaagcccagggtttttgtctagcagagtcaaaaacacgtcgatccaagatcggccaagctcactttgtcactggacttagcatttccgaccctgtcagaccccatgtacctagaaggacgaagcgggaaatgcgccagaccctgtattacgcaaagaaattcggtctggacgaccacctcggctacagaggttactctgattggcgcactgcccagaccgagattaaccgcttagacggcctggtgaagttcatcggacaccacgagcccacactggcttcgagtcttaaaagagcatggtccgaaattctgagggacagcggcaatcaggctagtttcgagccccgcaatcagcaccgggaaccctttacaatattcgtagacgaggcggagttcgagaggaatggccgacccgtactggcccttgctatggcagctacacaacaccccaacgtgattcatgacgatagcgaccgggttcttcaggcttacctgtctgacctttttgccgacgggcgacctgaagtgatacggaaaaaagggctgcacttcgttgatgcgaccgaagatctgcgcagatcttacgttgaggcgatgaggtccatgccattcgagggctacgtggcttttgtcgagtacgacggtgcagcagattacgaagcagcatacttgtgtctcctagaagccatgaccccgcgacgtttgatggcggctgaatcacaaatggcatccttcatcttcgaggaaaatgataaggtgtctagaactgcaatcgaaacttgtgtgattgctgtccattcagccctcgtggagcgttgcgataggcacccaaagtgcatcggcatcgattatgctagtaagccccatgccggaatagcactgtccgacttcctcctaggggtcctggggcggtatttaaggagcgagcccccagccccaaatgctactagccgggacagattgcggtttgaacagctgcgcgacaagtatagggtcattctggatgttacgaacggccgcgagtacagcagaagaaggccaatcgccccctgggccgatcccttttga

SEQ ID NO: 14248 - RNA, 1752 nt, unidentified
  source 1..1752: mol_type = other RNA; note = synthetic construct
atgaccaatagggaagctctcatcgcggctattggtacagacctggctacgtttgatgcagtgcttgatttcgtcccacccccacggagagtgggatcggaagcaccggaaaccgagaaggtgcaggtgttggaaattcctgtatttctaagacacgacatcccgaagaggcgccgaaaaggcgaatttcgaaccgcatgggaaccagtgcttgccaagtccgagtacaaggccctggcacggaggctggactcattttttcggttaaccctggctgggttcacacacgattgcgcattcggatttctccccgggagaaatataagggaaaacgcaactgtgcactcagggcacaggcatctgttgggagtagacgtgcaggatttcttccctacaatcacacgtgcccgtatcgagcggctcttcacggaagtgggcgtggagacaagcgtggctgaactgctggctcggttcgttaccataggcggctccttacctctgggcctccccacttcccccgttctaagcaatgctgtgtctttgccaattgacgtcgcctgtgatgccttagctgcccgacggggagccgtttatacccggtatgtggacgatatgagtttctctagcgacgacgagctacctgacgtggaggatgtgcgaagaatcctggccgagaacggctttggtttaagtgagagaaagacccgccggtccaggattgggcaggctcactacgttactggcctttcagtgagtgatggtgtcggaccacacgtcccccgtgagagaaaacgtcgcctcagacaagaacttcattacgcacggaagttcggcctcgcggatcacctgcgccacttaggcgtcaacgacgatagggtcattcagcagcaggttaaccgcctggacggcatggtgcgtttcgtggttcaccatgagcccaggatcgctccccggttgagaaccgagtggcgtgcgctgctgaaggataatggtatgtctccatccttcgtgcctcgcgggcagcatagagccccattttacatgtttatagacgaggccgagtttgacagggatggggagcgaattctcgccttgtgcatcgcgatcactcaacatggcccccttatcgcaggagagggggctgctattctggcagccgccatgacagatccgtttagcgacggcaatgttgacgctctgcggagaagaggtctgcattttgccgatgctactgaggatctccggctggcatacgtcaccagattggcaagcatgagatttgagggtttcgtggccttcgccgatcttcctgatccggccgcctacgaggaaacgtatcttcggttgctcggagccatgatagagcgccgactgatggcagccgagagccagtatgcctatgtattctgtgaagcaaacgataaagtcgggcgcggagggatcgaggaatgcgttgcgactgcgcaacgccgcctgaaagaccgcgacgatagaaggcctgtcggcgtcggagtggaattcgtaaacaaacctcatctggggattagtgtgcccgactttctcttgggtgtcctagggcgctacctgaggtcaccacctgtacccgacggaaggccagaacgacgggagaggctgatgttcgagcggctgagagataaataccgcctgattctcgacctcacagactggactgaatattctaggcgaaggcccatcaggccatggaatgacgccggcaacgacgctccttga

SEQ ID NO: 14249 - RNA, 1746 nt, unidentified
  source 1..1746: mol_type = other RNA; note = synthetic construct
atgtccttcaattacgatttctcccgcattaccagccggggctccctactggctgcgctttccatagacgaggcactcttcacacaagtcctagattttgtgccacctcctccggcatggtcagtccctccaagccccccagatgaaatctcaaagctgatggtgcccgcctttttgcgccatgatattcccaaaagaaacaccaagaggggccacaggacagtgtgggaaccggttttagccaagggaacgtacaaagcattgggtcgccgccttgactctttctttcgtcacaagctggacggctacccccacaagagttccttcggatataggccaggcaggaacatccgtgagaatgccgccgtgcatcgaggaaagaagtttcttctgagtctcgacctgcaagactttttccccagtatttctcggtcccgcatcgcctcaacttttgagcatctgggtatcgcccctgacatagccgctcttttagcccgatttgtaactattagtgatgctctggcgatggggctgcctacttcccccaccatttccaatgctgtggctctttgcctagatcaggcactagaggaactggcactgcggtcaggggcagtgtatactaggtacagtgatgacatctcaatatcttctgataatgccctcccagacctggccctcatcgcccaaatcgtgagcgataacgatttcaagcttgccgacgagaaaacgagactgagtgtccgggggcaggctcactatgtaaccggattaagcatctctgaccctaaccagccacacgtgccaaaagctaaaaaaagacgtttgagacaggagttgtactacgctagaaagttcggcttgggtcagcatttacaccggcagggcattaacgatcctacagttgtgcagcaggaggttaatcgactggacgggatgattaagttcgtggggcaccacgaaccaaagctgtcgtcagtaataaaacaggagtggtgcgaaattctcactgcagctgatatgaaaccgtccttcgcccccagaggaatgcatagggccccatttgtactcgtcattgacgaagctgagttcagcagggacggccaacgatacctcgctctgtgtatcgttgtgtctcagcaaatggacagggtcgcagaggaaaccggacgggtgctgagcaatgccttgaatgacctctggggcgacggtaatcggaacgcaatgctcgcccgggggctgcatttcaccgatgctactaaggatctccagctggcctacatcaaggagctggccaccatgcctttcgagggctatgtcgcgttttgtgagtacgacggccccaaaaactatcaagcagcatacctgcgcctgctgagcgctatgatccctcgaaggctcatggcggccgaatcacagtatgccgcggtgttggtcgagcagaacagcaaagttagccagacagctataaccgagagaattagcgaagtggccgccgatcttaagagaacaaacaatcgccgtcccaaagatacactatccaagctgttgtctaagccaaaccccttcctgtcgcctcccgactttttacttggagttctcgggcagtatctgaaatctaaaccggcggcacccgaaccaagagaacggttgagctttgaacggctgcgcgacaagtatagactgatccttgacctcgatgccagggctgagtacagtaggcgacgccctatcgcaccctggtga

SEQ ID NO: 14250 - RNA, 1746 nt, unidentified
  source 1..1746: mol_type = other RNA; note = synthetic construct
atggcttttgtttatgactttactcggattaccacccgagatgccctgctggacgcactggcgatcgatggcgctttgttcgatcagatcttagccttcgagccaccccctcccgcttggcttgagagcaagtccgtgagggactccataggtaccatctccattcccgcgttcttcagacacgacattccaaagaggaatgcgtctcgggggcatcgaaccgtgtgggaaccagcccttgcaatggggagttacaaagccctggccagacgcctggatgatttttttagatacaaactcgtcggttatccccacgatagcagtttcggctatagaccagggcggaatattcgggaaaacgcagctcctcaccgcgggaaaaagtttctgctgagcatggatttagagtcgttctttccttcaataagtggcacccgagtcgccggcttattcgagactctgggcgtgcagccgaacgtggctaacctccttgctcgatttgttacactgggaaacgggctggcaatgggatttcctaccagcccggtcataagcaacgccgttgcccttcccctggaccaggctttgcaacagctagcgaggtctactggctggacatatacgagatactctgatgacataagcgtgtcatccgacaactcctttcccgagattgaccaaatctccggcgtcatcttcgataatggatttcaattggccgagggcaagacaaggtggtcccggcagggtcaggcacattttgtgactgggttatctattagtgatcctgcccaaccacacgtacccaaggccaagaagcagaaactcaggcaggaactttactacgcacagaaattcgggctggctgatcacattcagcgcaaaggagtgaatgacccaaagatcatgcagcaggaggtcaatcgcctggacgggttggtgaagtttgtgtcttatcatgagcagaaactgtctcctaggttgaaggagcaatggcacaagattatcacagttgccgatatgaagcctagtttcgaaccgaggaaaatgtcaagggtgcccttcgccttgatcatcgacgaggcagagttcccacgaggtgaccgacgttaccttgctctgtgcattgtggcaacgcagcatgtagataaagtcataggcagcacacggcaggtactgacgacagctctcaacgacctctgggcagacggaaaccggcaaagcctccttgcacgcggcctccacttcaccgatgccacaaaagacctgcagctggcctacattaaggaacttatgaccatccccattgagggatatgtcgccttttgtgaactgcacagccatcagaactacgaaactgtgtacctacggctcatggctgccatgatgccccgcagactgatggcagctgagtcccagaaggcctcaatcatggtggaacagaactcaaaggtatcgcaaactttggtgaacaggtgcatagcggacgtgttcgccgaactgaaacggaccaataatcggaggccacgtgacctaactattaatttcgttaccaagcctaatcccatcctgtcccctccagacttcttgctcggagttttaggtcagtatctgcgctcaaaacctgctgaacccgagccgcgtgagagactcaattttgaaagactgcgcgataagttccgcctcatcctagatctcgataacgacatcgagttttctagaagacgtccaatcagtccttggtga

SEQ ID NO: 14251 - RNA, 1776 nt, unidentified
  source 1..1776: mol_type = other RNA; note = synthetic construct
atgtacgccctgcacttcagtcgactcaagacacgcgacgacgtgatctccgcacttactattgacgaggcattgttcgacaaaattattgcttttgaacccccccctcctgctgctcctagatctgcggaacctccagtgcctaaacccgaagcagccgtccaaacgatagttttgcgagagccacctgtcttcttccgacatgacatcccaaaaaagaacaaagccagagggcacaggactgtgtgggaacccgtgaattcaatgcctgcctacaaagccctggcccgtcggctcgaggcattctttaccatgctcccagactacccacatgaatgtgcatacggatataggccgggccggaatattagggagaacgccagcgctcattccggcaataagttcctcttgagcctggacattaaagacttttttccatccatcaccgtggagagagtccggtggctgtttgaagctatgagcatcgaggcttacgtcgccgatctgctagcgcgcttcgtaacaatcggcggtgcactaccactgggtctgcccactagccccgtgatcagcaatatgatcgcgctccctctggatgacttactcagggatttagctggtcagtacgaggcagtgtatacccgctattctgatgacataaccttctctggcaatggcgatctgcccgatatcgaggagatcagacccgtgcttgcagctttcgattttgccatcgctgataggaagactcgacgttcaaagcgtggccaggcacactttgttactgggctttcaatttccgatcctgctcaacctcacgtcccagcggacaagaaaaggtccttaagacagacgctttatttcgcagggaagtttgggctggccgagcattttcagcatcgaggcatcaacgaccagaaggtgattcagcgggaagtaaatcgcctcgatgggcttgttaaatatgtcgcacaccacgagccccgcatggccacatcgctgaaagagcagtggagacaaatccttgccgactcggggatgaagcccagcttcacaccacggggacagtaccgtgcacccttctatttactggtagacgaggctgagtataggcggggtgatgacaaaatgctcggactggccatggctgtcacacaacacccgcagagactggccgacgaaaccaacggtatactcacccgctttctagccgacttatggtctgatggaaacgatacagccttgaggaagaacggcctgcactacacagacgccaccgaagatctccggagtgcttacgtgaagcagctggccacgatgccgttcgagggctacgttgctgtgggcccccttgacgcggatgcaggatacgaggcctcatacctccgactgttgaaggcgctgataagtcggagactgatggccgccgaaagtcagtttgctttcttgattatagagaagaacggaaaagttgcccaggacgcgatcaaggcctgcgttcaagaagcttttgatgccttgaaacttgccgacaacaggcgccctaccgccttcggagtgaatttcgtggccaagccgaatgctttgattagcgtgcccgattttctactcggggctctggggaagtatctgcagtctaacccagcagcaccaggacgcccagaacctagagagcggctgctgtttgagaggctgagagacaaatatcggctgattgtcgatgtagatccctggaccgaattcactaggcgcaacccggtgaagccttggtcctga

SEQ ID NO: 14252 - RNA, 1749 nt, unidentified
  source 1..1749: mol_type = other RNA; note = synthetic construct
atggaatactggcacgacttgtctcgattggaaagccgagaacaactcattaccgccttgggcatacccgcagccctgtttgacgcaatactggccttcgagcctccgattatcgggtgcccggtcagtgaccctacaattactacagagattggtatccccctgtttatccgtcacgacatccccaagaagaataaaactagggggaatagaacggtgtgggagcctttattaaacaaatctcattacaaggcgctcgcccgacggctgggtagctttttccgcttgaaactagatcaatatcctcacgattcagtctatggatacatgagcgggagaaacatccgcgagaacgcaaaagcccacactgggcatagggttctgctgagtatcgacatacaggattttttcccatccattacaaccgaaagcgtttgcagactgttccagtccctcggagtgaacgcaaccgtgtcaggccttctctcccgcttcctgactatcggtacaactttacccctggggtttcccaccagtcccattatttccaacgctattgctcttcctattgatctcgagcttaaagctctggccgacctcatcgacgctacttatacccgctatgcagatgatctctctttctctagcaatggcaagatcccagacgttgaggaagtgagggccatacttggttccaacggcttcaaaattgccgacgcaaagacccggcagtcaaaaatcgggcaggcacactatgtgacaggactatccatctcggacccgcttaggcctcatgtaccgcgcgagagaaagcacagcttacgcagagagctgtactttgctagaaagtttggccttgcagaccacctgcgtcatcggggagtgaatgacgactcagtcatccaacaggagattaaccggatagatggcttcgtgaaattcgtggctcatcacgagccacgcatggcagctgatctgaagaccggttggagggagatacttcttgccaatggagccaagccatcttttacccctagaggacaatacagagccccattttacattttcattgatgaagccgagtatgttaaaaccggccataaaattctggctctcggtatgacggtgacacagcatgcgcaggagctcatcagtcagacttcagaggtcctgtctagcgctagagctgatttatgggctgccggaaatactgaaatactactgaagaagggcctacactttagcgatgccacagaagacctgaggttggaatacgtaaagcggctggcggccatgccattcgaaggctatgtcgcctttgctccttgtaagagtcccgccgactatgaggccacatacctccgcctgctgtcagccctgattccaaggcggttgatggcagcagagtcccagtttgtatttatctactgtgaggaaaactctaagatctccagggacgaagcgaaggctaagatccagagggccttcgatgatctgaaagctagcaataatcgtcaccctaagggattcgcagtggagttcgtgagcaaacccaacctcgggatctctgcgccagacttcctgctaggcgtgctggggacctacctccgatccgagccaagtcccctgggcaaaccagagcccagggaaagattgatgttcgagcggctgcgggataagtatcgtctcatcttggatgtcgaaacgtggaccgaatactcgcggcgacgccctatcgaaccctggtga

SEQ ID NO: 14253 - RNA, 1755 nt, unidentified
  source 1..1755: mol_type = other RNA; note = synthetic construct
atgaagttccactacgatttccggcgcctcagggacaagcagcagttactggatttcctaggcattactgaggcgttttttgagctcgtggtgtcattcgaagtgcctaccgaccctcctccaccacctgtctatgcaggtgggatcgaagagttgtccattcctccgttcttaaggcacaaaattccgaagaaaaacaagaatcgggggtgccgcgtggtatgggagcctttgctgtttaagactacatataaaaccctggggcggcgcctcaacaacttcctggtgaatttcctgagcaactatccacatcccgccgcttatgggtacctgggaggtcgaaacattaaacagaacgccgccgcacactgcggtcacaaatttttgatctcggctgacatcgtagacttctttcccagtatcacatgtgagaggatcaaaaacctctttatcgatctcgaactggtacccgatgtggctatcgcactgagcaggtttatgacgataagcggcgcattgccacttgggctgcctacatctcccatactgtcaaatgccatttttctgcccgtggacattgaattgcagtaccttgcctctcaggccggcgctacctatactaggtattctgatgacctatcattctccagtgatcgtaagctgcttatcctggaacagattggtaagtcacttcaggacaatggatttaaaatcgcagaagagaaaaccaagatttctcgccttggccaggcgcattatgtgaccggcttatcgatcactgaccccaacggcccacacgttcccagagacaagaagaggagactgcgccaagaactgtattacgccaaaaagttcgggctcaatgatcatttcaaacatcaggaggtaacggacgccaaagcccaacagcataacgtgaatcgactagatggcctggtgaaatttgtcagttaccacgagccgaagcatagtgctcgtttaaagtcccaatggtcacagatactcatttccagtggaagtcgaccatcatacgaaccacggcgacagaagagagtgcccttctgtatctgcattgacgaggccgagttccagttttcccagggagtcgttctggccctgggcatgagcgtgagtcagcaccaggacgaactcgatatggcggccgctgaggttctggataagtggctcagcgacttttgggcagctggaaatcagagggtgatcgaaaagagagggctccactttgtcgatgcaagcgaggatcttaggctccaattcgtcacaagaatgcaggcattaccatttgaaggctacatcagcttcggccggctgttgtctcctgcctactatgaggaaacctacttgcgactgatagagtccatcattcggcggagactaatggccgctgaatcccaacttgccctattcgtcatagaggagaactccaaggtgtctaatcagagcgttcgagcagctatcgatcgggcctacgatgagctcaagtcatccaataaccgcagaccacgtgcgatcatcgttcaatttagatccaaacctgacctttctataagctttcccgacttcctgttgggagtcctggggaagtacttgcggagccgcgaccaaaaactgggaaccccgattcccagggatagacttctgtttgaacgtctgcgggacaaatacaggctgattctcgatgctgacacaggtttcgagttctctagacgccgcgagattcagccttggatctga

SEQ ID NO: 14254 - RNA, 1728 nt, unidentified
  source 1..1728: mol_type = other RNA; note = synthetic construct
atgcgcaccaaacagcaacttctaaatttcctggggcttcctgaggaggtattcgaatttgtggtgaattttgaacctccaccggacccccagccacctcctattgttgttgaaggtgttcagcagatttctgttccccccttctataggcacaagattcctaagaaaaataagaaccgaggatatcgggtcgtatgggagccccagatcgctaggcttgagtacaaagctctgggcagaaggttaggaagcttctttaagcacttcctcaccaactacccccacccggccgcttatggctatctgggagggcggaatatacggcaaaatgccgccgcgcactgcgggcatagattcttgctgtctacagacatagccagtttcttttcctctatctctatcggtcaaatcaagggcctctttctggaccttggaatttgtgccgatgtagcagtgcccttgtcaaggtttgtgacaatcggcggagtgttgcctctgggccttgccactagtcccgtcttgtccaacgcgatcttcctccctgcagatactcagctgcaggccctagcagacagagtgggagccacttacacaagatactcagacgatctgagtttctcctccaacgggaatctcccaccgatcgaagacataaccaaatgtgtccaaatccatggctttcgactggcggagggcaaaacgaaaacgtcggagcatggccaggcccactacgttaccggcctcagcatctctgacccttccagtcctcatgccccaagggagaagaagagacgcctgcgtcaggagctgtactacgcccacaagtttgggctgaactcccactttcaaaggattgaggcagcaactaccaaagaccagcagcagaatgtgaatcggctggatggattggtgaaattcgtggcttaccatgaaccacgccaggtgggtagattgaaaccagtctgggcaaacatactcgcctcctcaggggcaaggcccagttttgagccccgacggcgcaacggtcctcctttttgcatcagtattgacgaagcagagttccagaatgatcaaggcactgtgctagccttaggcatggtggtgtcgcagcaccaagaccaactcgtctcagctgctagcgaagtcctgaatagatggctcgccgacccatgggctgtgggaaacaggctggctatcaacaagcgcggcttgcatttcacagacgccagcgaagatctgcgagccgaattcgttattcggatgcagacccttccatttgaggggtacatttctttcggacagttgagcgattcatctgaatatgaggcaacatatctgagacttgtcgggtctattattaaacggcgcttaatggctgcggattccgagagcgtgttatttctcatcgaggagaattccaagataagccagaacaaggtactgttcctcatcgatcaggagttcaacgagctgaagctgagcaataaccgtcgtcccaataagatcaccatacagttccgccacaaacccgaccttaacatcagctttccggacttcattctaggtattctcgggaaatatctgaggtcaaaggatgccaagccaaacgcacccatgccaagggatagactgctgtttgaacggctccgcgatcggtaccgcttaatcctggatgctgacacaaaggctgaatttagccgaagacgtcccattgaaccatggatgtga

SEQ ID NO: 14255 - RNA, 1755 nt, unidentified
  source 1..1755: mol_type = other RNA; note = synthetic construct
atgaccagcttatatgacttctcaaggattactacccgcgaggcccttaccgccgtgttgggaatcgatgaaacgatgctggatctggttctgacttttcagccaccgattgactcccccacagccaagaatagccctgaagctataaaaaccatcacgatccctgtgtttctgcgacatcgggttccgaaaaaaaatagaaacaggggattcagaacagtgtgggagcctatcctccttaagagtagctacaaggggctggctagaaaattagatgccttctttcgtcatcatctagtgggctatcctcacgagtccgcatttggctaccgccccggtaggaacatccgagagaacgcacaggtccatgccgggagcgctaggattctcagtctggacctggccgacttctttccaaacatctctaagggccacatcaagaaactttttctggctatgggcgtgaacgcgaccgtctctgatctgctgtcacggtttgtcactatcgagggtgccttggcactgggattgcctacttcccctgtgctctccaatgcgattgctctaccaattgatctggacctcggtatcctggccgatcagtcgaatgctagatactccaggtatgctgacgacatcacattcagcgggaacggagaactacccaccttggaacgcatagaggattgcttaaggcagcacggctttcaaattgcagaaggaaaaacaaggtggagcaagcgtgggcagtcacattacgtaactggcctcagtgtatccgaccccgcccaaccacacgttcctcgagataggaagcaggcactccgccagcagctgtattatatggagaagtttggcatcgatgaccatttccgccgcattgggacaaatgattcagatgtgatccagcaggcgttgaattcaatcgacgggatggtgaaattcgtggcacatcatgaaccttgcatagcagcccccctgaagatgcagtggaatgaaatattgcgtgtgaacgggaagaaaccaagtttcaaacccaagaagcaaaatagagagcccttctacatttttgtcgacgaggcggaattcaaacgggcaggtacgaccgttcttgctcttgccatgtctgtctcgcagcacgaagaaagaatagtccaagagacacgggaggtactcgaggctgaaatgcaagacttttgggccgccggcaacatcgacgccctgagaaagcgggggctgcacttcgcagacgctaccgaagaccttcgccacagctacgttaagcgcctggcgagcatgccctttgagggctacgtggcctttcacccgtgtgcagatcctcgaaattatgaggacacctacctcagactgctgggcgccatgatttctcgacggctcattgccgcagaatctcagttcgtctgtctctatttcgaggagaacagtaaggtgagccaggaggccgttcggagtctggtacagtgcgctcacgatcagttgaaaagagccaacaatagacacccaaagctctgtgtcgtgaagtttgtgtctaaacctaacttcggaatttctgtgccggatttccttctaggagtgctgggcaagtacttacactccaaaccagctgccgctggtggaccagaaccaagggatcggttgatgttcgaccggttacgcgataaataccgtctgatcctcgacctgtccacttggacagagtattcacgaaggcaacccattgagccctggcagtga

SEQ ID NO: 14256 - RNA, 1755 nt, unidentified
  source 1..1755: mol_type = other RNA; note = synthetic construct
atggcctacacgtacaacttttcggacatacggacccgtgaggcccttttggctgtcctcggcattgatgagacaatgctggacctggtccttagtttccagccgccaatcgatcctcctaccgtgacgattatcccagacgtcattagtacgttgcagatccctgtcttcttgcgacatagggtgcctaagaagaatcgagcgaggggtttccggaccgtatgggagcccatactccttaagagcacttataagggtctgtctagaaagctcgacgtttttttcagacaccacctggcaggatatcctcatgagtcagcatatgggtatcggccaggcaggaacattcgggaaaatgcccaggtgcacgtcgggtctgccaggatactgagcctggacatcgccgacttttttccttcaatctctaaggagcggatagaacaattattcttgggcatgggcatgaacgctgcaatctctgatcttttgagccggtttctcactatcgaagggaccctcaccctaggctttccaacaagtcccgtcttatccaacgccatctccctgccaattgaccttgagttgagctcggtggcgcgacagtttgatgccagatactcacgttatgctgatgatatcaccgtgtccggcaacggggatttgccaagcctggaagcggtcgaggactgcctgtgccgccatggattccaactggcccctggcaagactcggttcagcaagcgcggacagtcccattacgtgacaggtctgtctgtgtccgatccagttcaaccccacgttcccagggaccgcaaacgcgcattgcggcagcagctctactacatgacaaaattcggggtagatgaccacttccggagacttggtatcaacgatcctaaagtcgcacagcaggctatcaatagcattgacggtatggtcaagtttgtggcacaccatgagccaaggattgcggctccgctgaaatctctttggaatgaaatactgagagtgaacggcgagaagccatctttcacacccaaaaggcaggataggaaacccttttacatatttgtagacgaggccgagtttgaacgcgcagggactaaagttctggccctggcaatgtcagttagtcaacatgaggagcagatcttccaggaaaccaacgaagttctggaggctgagctcggggacttctgggcagctggcgatatcaacgccttacgcaagaagggactgcacttcgctgacgccacccctgatctccgacagagctatgttaaacgcctggccgcccttccattcgaaggatacgtggccttccacccctgtgacgacccatgtaactaccagtccacttacctgaggctactcggctcaatgattagtcgtcgcctgattgctgcggaaagtcagctcgtagtgatttgctttgaggagaattccaaagtgtctcaaaagtcaattaaggaactcgtgcagttcgcccacgatgaactaaagcgtgtgaataatagacaccccatttcctgtgtggtgcaatttgtaagcaagcctaatttaggaatctccgtgcccgactttttactgggggtgctcggaaaatatctacagagcaaacctgctaatgctggacggcccgagcccagagacagactgatgttcgatcgactgcgcgataaatacaggctgatcctcgaactgccgtcctggacagaatatactagaagacatcccatcgagccgtggcagtga

SEQ ID NO: 14257 - RNA, 1752 nt, unidentified
  source 1..1752: mol_type = other RNA; note = synthetic construct
atgtcctttaaatatgacctgacccagctgcagaaccgcgagcagctgatcaacttcctgggcctgtctaaggacgtatttgaggatgtactcgacttcgatccaacaggctccaacttctcccagttttccgaaaaggaatcctccctgattgagctccctttgttctttcggcatgaaattcctaaaaagaaccggcaacgtgggtataggacagtgtgggaacctactttcctgaagtcaccctataaggctctcgcccgtaggctaaataattttttcgcccacaagcttgagggatttcctcacgcccagacctatgggtacatcagcggccggaatattcgggagaatgctcagaaccattgcggacacacccacctcgttagcatagacctcgaggatttctttcctagtattaaggcctctcgcatagcgaccttcctgcgtacgacaggcattacacccacggtggccgatctggtgtcgaggtttgtcaccatcgaaggaagtctgcccttaggccttccgactagccccaccatagccaatgccatctgtctgccaatggacattgaacttgaggcactcgcccaaaagctaggcgcgacttttagtagatacgctgatgacatctcatttagctctgacggcacctttccatcgctgcgggagttgatggcttgtatccgtcaacacaatttcgaaattgcggaggcaaaaacaagaacttctaaattaggacaagcccattacgtcaccggtctgtctgttagcgatcctgcccagccgcatgtccccagaaagaagaaacgacgcctcaggcaggagctgtactatgccgataaatatggtcttgacgatcacctgcaccacgtgggattagggaacagtagatttgcacagcaggaaattaataggctcgacgggttggtcaaattcaccgcgcaccacgagccacgcctatctgctcatctgaaaactacatgggccaaaatcctgcagaccagcggacatcgaccatctttcgctcctaagaatcagcataggcttcccttctacatctatattgacgaagccgaatacgcccggccctcaggagataggttgctcgctcttgctatggcagttagccagcaccaggaacaaatcaacagggcaacgcaggatttgctagagactaccctgagtgatgtgtgggcggcagggaacttggacgctatcgctaagaagggtgtccatttctcagatgcaactgaggatatgagacttgcttatatcgacagaatgcggcttctcccattcgagggctacgtagctatggccaggctaccatccgccgcggactatgaggtggtgtacctccgattactgaacgcaatgatcaaacggcgcctgatggcagcagagtcccagtttgccaatctggtctttgaagagaacagcaaggttcgacaggaagccataaggaaaacagtgacagacacttacgacgccttaagagaatcaaacaatcgacaccccgagtactgcagcgtggagttcgccgggaagcccaattttggtctgtcaatacctgacttcctcctgggcgtgctggggaagtacctgacagtgggtccccaacaggatggcaagccagcagctagatacgtcttgctcttcgagcgccttcgcgacaaatatagattgatcctggatgttgacaactgggtggaatacacgagacgccggcctatcattccgtggtga

SEQ ID NO: 14258 - RNA, 1752 nt, unidentified
  source 1..1752: mol_type = other RNA; note = synthetic construct
atgaccttccgctacgatcttagactgcttaacagtcgcaaatcactactggctttcctgggcgtcgatgagattgcatttgagaaggtgctgagttttgacccagtttcagcacagatgtccatcggcattgaggatgatattcactttttggaggctcccctgttcctaaggcacaagattccaaagaagaaccgagctcgaggctatcggatcgtgtgggaacccacggcttttaaatctgaatataaggccttggcaaggaggctgtccaatttcctctcacatcggctcaacggtttcccccattccaggacctttgggtatatcgggggccggaacatccgtgaaaacgcgagggatcactgcgggcaccgtcacctgatcagtttcgatctggagaatttcttcccctctataagcgcggccagaatcacaaaactcttgatcagtaccgagattgacccgggcattgccgacttgctgagccgctttatgacaattaatggaagtctccccttgggcttgcccactagccccactctggctaacgccatctgtctgccaatggatattgaactacaactcctggctcagcaacatcttgccacattctcccgctacgctgacgacatcaatttcagttccgacactagtctgcctcctctggaaaaatttgcaacgctggtgaaatctaatggatttgagatagccaagagcaaaacccgcatcagcaaactcggacaggcccattacgtgacagggctgtccatatcggacctggcgcatcctcatgtcccccgacacaaaaagaggaggctgagacaggaactttattatgcccagaagtatggtctggaggatcatctagtgcggagaggcattaacgatcaccagctcatccagcacgaaatcaatcggctggatggccttgtaaagtttatcgcttatcatgaaccacagctgtctgcgaagcttaaaaccaactgggccgatatattacaagagagcggtcgccgacctagcttttctccaaagaatcaggctcgccctcccttttgtatttacgtagatgaggccgaatacgttcggccagacggaacccgtctgctcgccatggggatggccgtatctcaacaccaggaccgagtggtgcaggcagccaaggatgtgcttgaggagacaatttccgatcagtgggctgccgggaacaagcctgccatcgtgaagcgcggattacacttcgccgacgcgcaccctgatttacggctggcatacatcagacggatgaggagcctgccattcgaaggatacgtcgttatggcacgtttggactctactgcaagctacgaaggcacttacatcagactgctcaacgccataattagaaggagactaatggcagcagagtcccaagctgcactgcttgtctttgagaaaaatgacaaggttagccaagtgaccatccggcaggccgtcatgcagtcatacgagtccttacgaaagtctaacaatcggcgccctgtgggttgctatattgattttgtctcaaaacctgacctcggaatgtcagtgccggacttcctcctcggtatccttggcagattcctccggtcaggaccagggaaaatggaagatcagttcgacagggacagaaaattgttcgaatctctgagagacaagtatcgcttgatattagacgctgacagctgggttgagtactcgaggaggagagagatttccccgtggtga

SEQ ID NO: 14259 - RNA, 1764 nt, unidentified
  source 1..1764: mol_type = other RNA; note = synthetic construct
atggcgttcaattacgaccttagaagaatcaagacaaaggagcagctgctgacatacattggtctagaggaaatgtttttcgaccgcgcattaactttcaacgtcgcagaatacgaagctttgatggctgaacctgttgtggagatgggtatcaaagagctctatcttcctacgttcagcctgcatgaaatacctaaacggaatcccaagcgaggcaaacgcaccgtctgggaggcaaactctcacatcaatgacgcgctcaagggactctccagacggctgaccctcttctttgagacagtggtcccaggctttccccaccctcaaaattgtggatacgtacgcggcaggaacatccgtgagaatgcgcagttccacattggtgcaaaatacctgctaaaggccgacattgaaaactatttcccatcgatctccatcggccgaatcagcacgtttctggagaggctcggagtggcctcagaggtggccaagcttctctcaaattttctatccatcgatggaaaactgcccttgggcctgccaacatcacctataattgccaacgccattagtcacatcatggatattgatcttaactctctggccgagaagcacggggccatctactcccgctacgcagacgacttgacgttctctagcgaaggtgagctgccgaccgaaatggccattagcgaaatcgttgaactgcatgactttactttggctctggataagactaggttgagtaagcgtgggcagaatcattacgtaacaggtttaagcgtgtccgctaccgacgctcctcatgcacccaaaagaatgaaaagatccctcaggcaggaactccactttagtaagaaatacgggctggatgatcacttagaacatcttggcctcagccaccactttgcacgccagagttatataaatcacctggacgggagagtgaagtacatagcctttcatgagcctaaccttgcctcaaagattgttccactgtggcaagagatcctggaggagtctggcgactccccatctttcaaacccaaaaatcagaataggaagccgttccagttttatgtggatgaagccgagtttgagctcaacgggataaaatacctggctctcggcatgagcgggacccagcatcaagaccaccttaacgacgttactgaaaaggtgctggaagattatttggcggacccgtggtcagacgggaacagggagaagatcgataagaaaggaatgcacttcactgataccactgaggatctcaggaagatctatttgtctgccctgcagcccctgccattcaatggatacattgtcttcggcaaactcaccgctgattaccaggattgttatcttgaactgctgcgatttgtgctgaagagacggttaatggccgctgagagtcgggccgcttatttccattttgagcaaacatccaaagtatcgaaagacgctataaccaagaccgtcgacgatgtgtggaaagagctactgcgggagaataaccgctgccccgagtatgtcgtcatcgatattgtggataagaagtatttcggcgttgcagtacccgatttcatgcttgccactttctgcagatatttaacaaccaatctgagcgaaaacgactaccgacggaaagccaacatgtttgagatgttgcgtgacaagattcggttgattgtgaatgcagacacaggagaagaatttgggaggcgcaacccactggtgaaccctgacatcgagaacctgtga

SEQ ID NO: 14260 - RNA, 1764 nt, unidentified
  source 1..1764: mol_type = other RNA; note = synthetic construct
atggcattcgattacgaccttcgtcgcattaaaactaaaggtcagctcttaacctatataggcctggaggaatacttctttgacaaagccctcgacttctcagtgacagagtatgaagcacgaatggctgagtatagcaacaagacggatattggatctttatttctcccgctcttttggaagcatgagatccccaagcggaacccaaaaagagggaatagggtggtctgggaggccgattcccatataaataatgcgctcaaagggctggcaaggagacttaccctgttttttggcaccgtaattccagacttccctcaccctcaaaattgcggctacgtccggggaaggaacatccgagagaacgcgcagttccacatcggtgccaaattcctggtgaaagcagatatcgaggattatttcccgtcgattagtttcgaacgtgtgtctaaatttcttgagaatctgggggttaacgccggaatcgcacgccagatctccaatttcttatgtattgacggaaagctgcccctgggactccccacctcacctataatcgccaatgctatcagccacctgatggactttaaccttaatagtctggcccagacgcacggatccgtctacagtcggtatgcagacgacctcacttttagttcagacgacaccttgccatctgaggatgatatttcgaaggtggtcgagcaccacggcttcgctcttgccgccgataagactagacatagcaagcgcggccagaaccactatgtaacgggtctgagcgttagtgaatccgatgccccccatgtgccccggaggatgaagcgttccctgcggcaggaattgcatttctcaaagaagtacgggctgaatgaccacctaggccatttgggcttacgagggcaaccagaacgccaaagctatatcaatcatgtggacggtcgcgtgaagtatatcgcctttcacgagcctggcctcgccgctactatagtaccactgtggcaaagcattctggaggaatccggcgaggggccttctttcaagcccaagaaccaaaacagagtgccttttcagttctacgtagatgaaacagaattcactttggatggagtcaaatatttggcacttgggatgtctgcttcacagcaccaagaccacctcaacgacacaacccagaacctttgggaagattacctggcaaatccatggtctgacggggctctcgaccagatttacgctaaaggcatgcacttcactgacacgaccgaggatctgagaagaacatatctgtccgccctgcagcccctgccattcaacggatacattgtttttggcaaactcacctcagactaccaggaaacctacttgacactgctaaagtttattctgcgccgcagacttatggctgctgaaagccgcgccgcccatttttacttcgaacagacatccaaagtcagcaaggactctttaacccgaacagtgaacgcagtgtggcaggagctaaggaatgagaataatcggaggcccgaatatgtggttaccgagatcgtcgataagaagtactttggaatcgcggtgcctgatttcatgctcgctgttttccgaaggtacctgactactacaccgagcgagaaagactaccggcggaaggccaacatgtttgagatgatgagggataaaatcaggctaatcgtgaacgccgacacaggtgaggaatttggcagaagaaatcagctggcgaaccctaacatagaggatttgtga

SEQ ID NO: 14261 - RNA, 1764 nt, unidentified
  source 1..1764: mol_type = other RNA; note = synthetic construct
atggccttcgattatgatttacgacgggtcaagaccaaggatcagctcttgacatacatagggctcgaggacatcttttttacaaatgctagtgacttcgatgttcacaagtacgaggctcgacttgccgaacctctggtggagatgggaatcgcccagttgcatttttcccctttctataaacatgagatccccaaaagaaacccgaagcgaggcagtcgtgtggtctgggaggcatcaggtcatcttaacaatgccctgaaaagcctcgctaggcgccttaccctctttttcgagatgatcatctctaactttccacacccccataactgcggttatgtgagaggtcgcaatacgagagataatgcccaatttcacatcggagccaagtacattctgaagagcgacatagaaaattatttccctagtatctccctgcggaggctcatttctttcttcgagtctcttggagtaaactcgggcattgctatgcaactcagccatttcctgtgcatcgaccagaaattgcccctggggctgcccacaagtcctattatcgccaatgcaatctcccactttatggacatcgacttgaatggactcgctgacaagtacaaggctgtctatagtcggtatgccgacgatctgaccttctcttcaaacggcaatctgccacaggtttcagaagtgtccgaaattgtcgctaggcataagttccagttatccagcgataaaacaaaatactcaacccgtggacagaaccactatgtcacaggcctaagcgtgtcggaggaaaacgcaccacacgccccgaggaaaatgaagctggcgttgcggcaggagctgtacttttcaaagaagtatgggctcaacgaccatctagaccacctgggaatctccgatagctaccagaggcagtcttacataaatcatttagacggcagagtgaaatatgtagcatttcaagaacccagattagcttccaagatcggccctctgtggcaggaggtgcttgaggatagcggcgaggccgtgaactactccccaaaaaaccagcaccagaccagcttccaattctacgtggatgagactgagtttacactggatggggaaaagtaccttgcgttggggatttccgcatctcagcaccaagagcagctgaataacgttactaagagaatttgggaagattacatcgcaaacccctggagtgacggggacctggacgcgattaccaaaaatgggatccacttcaccgatacgaccgaagatctaaggaggacctatcttactgcactgcagcccctgccattcaccggctatattgtgtttgggaaactaggagtagactaccaaggctgttatctgtctctgttgaagactgtcctcaaacgacggctgatggcagccgagtcaagaggtgcttacttctacttcgaacagaccagcaaggttactaaatctgccatcactgaaacagttaaagcagcctggagcgagttaaagaatgataataaccgccaccctgagtttgtggcgacggaaatagtggataaatcatacttcggcattgccgtgccagacttcatgctcgctgtttttcgccgctacctgatggccgactccaaagataagcagtatagacggaaggtgaatatgtttgaaatgctccgtgacaagattcgcgtaattgtcaatgccgacactggtgaggagtttggacgccggaacccgataaggaacctggacatagaaaacacatga

SEQ ID NO: 14262 - RNA, 1770 nt, unidentified
  source 1..1770: mol_type = other RNA; note = synthetic construct
atggcccacgattatgatcttcggctgatttccaccaaagcgcaactccttacatacataggggtggaggaggaatggttcgacgtcgcatgtggattcgatgttgctgcttacgaccaagcactatgccaggacaccgagagcgagatcggaatctatcatcatcacccatttactaggcacgaaattccgaagcggaatcccgccagggggaagagagtagtgtgggaagctgagcgttacttgaacaatacatacaaaggccttgcgaggaggctgactcggtttctcgaaacagccattacaggttttccccatccccaatgcttcggatatgttaggggtcgcaatatacgggataacgcagggaggcacgtgggtgcaactcttctgctaaaagccgatatcaaggacttcttcccgtccattgacaaagctcgcgtcgagaagctctttgttgatctcggagtgaactccgaggtcgccacgcaactgactagcttcttaactatagaaggaaaactcccattgggcttgccaacatctcccatcattgcaaacgccatttgccacggcatggacggcgatctgagcaaactggcaaccaacagtgattctacctacagtcgctacgctgacgatattagcttttcaactaacgtcaccctgcctaaggccgaggcaataagcgtgatcgttgctaggtacggctttgagctggccaaagataagactcgggtgtcgaaaagaggccagaatcactatgtaaccgggctgagtatttccgaccctcgagcccctcatgcccctcgttccatgaaacgaaacctgcgtcaggaactgtacttcgcccgcaaatttggcctggacgaccatatccgaagtctaggcatcacagaaggagacgaaattcagagatacatcaatcatcttgacggttcagtgagatacgtggccttccacgaacccaccaaggctcgtgaccttctcgtgcagtggtacgcgatcttagaggaatccggttcttcgcccagctttgaaccaaagaaccagcacgacgcccaattttgtttttttgttgacgagacggagttcgaatggaatgacaagaagtatctggcactctgtttatctgccactcagcagcaggacgtaatcaataccacgacagagcgcattctgaaggactacttggctaatccattctcagatggggatagggaggccatttcccggcatgggatgcatttctatcacgccacagaagatctgaaaagcctgtatttcagggcacttcagaagctccctttccaaggatacatagtgttcggagagcagtctggcacctacgaggcggactatacaaagctgctgtcacagatcatcaaacgccggctgatggccgcagagtccaaggctgcattcttatgctttgagcagaacagtaaggtcagcaagcacgctatcgaggaggtggttagaagaagctgggaagagctcgatcggaccaataacagacgccctaagtatgccaccgtagaaatggtggataaatcatattacggggtcggggtgcccgactttttgctgggcgtgttcagaaagtatgtgtctggcgtgcctgctgcttctccaccccagaggcagcacaatatgttcgagggcttgcgggataaaatccgagtcatcgtcaatgcggataccggggaagagttcacgcgcagacacccatttgataacttttcaattaacgacctccgagaaagatga

SEQ ID NO: 14263 - RNA, 1716 nt, unidentified
  source 1..1716: mol_type = other RNA; note = synthetic construct
atggaacggttcatcggggtgaaatctgatcttcttgacctggtactggactttgactcggaatcatcaaacagtttcagtgagcagaattcccgcatatacatgttatcaatgcccctttttatctgccacaaaatccccaaaaaaaaccccaacagaggcgagagggtggtctgggaagccctgatggatttgcgcgatgtctacaagtccttttctcggaagctggacattttctttcaaaagcagattgagacgtatccgcacagctgcagctacggttatttgggcggtagaaacacccgaggcaacgccgagaaacatgttggaaaaaagtatctgctcaacgccgacctgtgcaacttctttgattccattagcgccgacaaagttcgtctcctgttcgtctcttgcggtgtggacgagaaaatatcacaaatcctcagcagattcctgaccataagcagtcgactccctatggggctaagcacatctccagtgatagccaatgttttagcacacaagatggattgtgaattgagtgatttagccgagaagttcaattgtcagtattcaaggtatgttgatgacttaaccttcagctctgacgagatcctgcccgagatcagccacatagaagagattgtagcaaggcataacttttccctcgctcacgaaaagattaagttctctaaaagcggtcaggcacactacgtaacagggctgtccgtgagcgacactgaagcaccacatgtgcctcgaaaaattaagaaagatctccgcaagtcactgtactacatggataagttcgggatttatgaccactttggaaggctaggcattcacgaacatgagaacgtgcagagagaggtgaacaggatagatggactcgtgcattatgtatcctatcacgaaccacggaaaagcttcgagatcaatgctatttggcagaaaattctgcgcgactccgggtttcgcccctatttttccgctcataaacaggaatacgaggtgttcaacattattatcgacgaggccgagttctctcacaacggcacaaattacttggcgctggcggctagcgttacaaataagcaacgggaaatcgacaatagtatttttgagatcctggataacttcctttctaatccttggtctgatggaaaagtggatctcatcaaggaacgtggccttcattatgtcgactgtactgaagacctgaagaaggaatttatccagtgtctccagatcctaccttttaatggctacattagtatcaatgccgtgggcgagtccaattatcgagatagatacatcgagaacttcaaaaacatcatcatgcggaattactacaagatcgatcgtagtatcgtgtttgtctcaatcgagcggaactcgaagatctccaatgacgacatctatggagttgtggattacgtcaactcttaccacctcaacgataaaagggtcatattgccgaaaggtaatgtgtccttcgtcggaaaggaatgcctgggagtcagcgtgcctgacttcctgcttgggtgtttcgcaggctacattaaggacaaccagaccgtttctgggggcgctaagtcaagaaagtttctgcaattcgagatgctgcgcgacaagattaaagtagtgtcggatctgaccactaatcagcattttacgagaaggaatccattttccaagagtaagttgaagatatga

SEQ ID NO: 14264 - RNA, 1752 nt, unidentified
  source 1..1752: mol_type = other RNA; note = synthetic construct
atgaaccaaaaagatatgccaagagggttcgaccgcaacagaataaagttcgacttcagggttttgaaggatctgaataccctgaaactgttcataggcgtggacaatatcaccgaatcctttattaacaccaaacatgaggttcacagatggttcatccagcataggattcctaagaaaaacactactagccacgataaatacaggattgtgtggcagccaattaacggggccgagcgcctgtacaagactctgaatcggaggtttgagatattcatacgtgatatcgaccggcggtaccctcacccatgttcatatggatatgtaagaggccggaacaccctagataatgctaagttacacattggagcctccgtgatcctccatgcagacatttctaatttcttccactccatcaagatcgacaggatcaaaaagctgttcatcagctatggcatcgacgccacaattgcaaattatctcagcgagattgtgactctcaacggttctctccccttaggtgttcacacatccccaatgctggcgaatgtgtgctgcctggacctggacgacaaactgtacaaattatctcagcgctatagctgtgcctactctcgatacgctgacgatatctctatcagcggatcagatctgcccagcaaagacgaagttgagatgatatttagtgaggaggggtttgtgctttcacaaaacaaattcagtatctccaagctgggtcagaaacattttgtgacaggactctccgtcagcgatcctcttacaccgcacgtgccccgccagattaagaagagccttcgccaagaactgtactattgcaataaatttggggtaattggccatctcgagcgaatctatgatggcagttttgacttcatacagaagaacattaacagaatcgacggcttcgtccgatacgtctctttcattgagcgtaaacccaattttaaggccgactggatggctatgttgagccaggagaacttgcgtattaactatcgcaacaagtcgaatgaacaatcaaatgaatgcgttatctacatcgatgagacaaaattcgagtttaacggggcctcctatttagccattgcccttgtccagacctcgaattttgaccttattgagtcagaatccaggcgcatttacgaagaatatatcgctgacccatttgcagcgggccggaaggacaacatcgccaaaaataaaatccacttcacggatgtgcatcctgatctgcagggcagatatatcgattggctgtacggtatagcttttgacgcgtacattgctttttgtaaagaggaaagcgccaactatcaatctctttatctcagtctgctctcgcgaatactccccgatcgactaaggcatttgcggaaccacaatgtaaagctcatcctagagcagaatccagaggtcagttccgaatccatcaagaacaaggtattcggcatcgataattacctgaagttgcagcagatccgcagtgcaaagactagtgttatagtgggatctaagcaagaatactatggattctccgtgcccgactttgtgctggggttgagcgccagatacgcaatttcaaactctggaaagcagcagaatgacagctcaaaccccccggctagagataccctgctgtttgaaaaaatgcgggacaagattcgggtcgtgtacgatgtggatgcaaagaggaagtacacgagacacaggccttttgtccctttccagtga

SEQ ID NO: 14265 - RNA, 1746 nt, unidentified
  source 1..1746: mol_type = other RNA; note = synthetic construct
atgttggatctgcggaatatgagggacgcatctgacctcgctaagtaccttgggatttccgagggccgcgccaggcagttattggtggctagtccggaagaggtcttcaagacttatgagatccccaaaagaggcaatcgcggtgttagagaaatatgggaggtgaccgaaacctgggcggccgacatgtataagggacttgcacggcgcctgaatgctctgtttgtcggcgccctggcgggttttcctcacccttctgcgcacgggtatgttgccgggaggagtacctggactaacgccctggcccaccttggacagaggcgagtcctatgcacagatatccgcgcctttttcaaatctatccagcatgaacgggtgcgacagttgctcctgcgctgtggtctaaataacgaagctgccgctgcactgagtagaatcctcagctgggatgaccacgtcccactcggattgcatacttcacccattgttgctaacgcagtgtgtcacgatctcgatgctcgcttacgggccttagcacctgcagggaggtatactcgctacgccgatgacctgtttttctctggccctgaactccccacccggaacgacgttgctgctgcccttgctgccgacggctttgagattgcccccaggaaatgggggttagccaaagcggggaggggactctatgtgaccgggctcagcctcgaacacggcgatcgtcctagagcccctagatcaatgaagcggagactcaggcaggacctccaccatgctgatagatacggtttgcgacaacacctggggcggagaggatacccttccttccaatccggaatcaacaagatacatggaaccatacaatacctgcgcggcatagaacgggacttgggggaccgtctaaacaaggagtggatggagctgctgggaagagagggagtcgcggtagcataccccacgcaagagaggctcgcgggtcgtactgtgctgtttctgctcgacgagtccgtccccccagacagagacgtgcttctgttatgcctgacagtggtggaagacgtggagtgggtttccgctgaagtgcagcggttcctggacgacaggatcgcagacacaatgaccgctgaaagcgaacgggcagtgctaaaacagcggggccttcattggaatgaacttacacctgacaacaggacacgggccacggaactgctacgaactctgccattccgtagtttcgtggcatacgctgcactgccaaagcaggataaggcaagctatgcagaaacctacgcccgtacactggctcagcttctgagagatcgcatgattcgatacgatggctgcacgctgaagatcgtcggcgaggagaatccaagggtaggacgccgcctgctgtctgagattgccaattcgatcttcagcgagctggagtgcttaggcgcacgaagacccgctgccgtgccaagttgtgaggtactgagcaaaggttccaacccggccttgccccttccggatctcgtcctgggggtgctgggagattttgccttgtcaatcgtcagaagcgagcgggaagaggtgggtgacggcaaaaagaagaggagatctggcgatcaggcctcgattcgctttgagcagatctcacataaagttaaagcgatttacgatttgcagtcaggggtggtatattccaggcgaaatcccttcaccgcctggccactcgataacgccagcacaggcggcgagtga

SEQ ID NO: 14266 - RNA, 1788 nt, unidentified
  source 1..1788: mol_type = other RNA; note = synthetic construct
atgtcattagacgattatattccgcaattggccaggccagcgaatgtggagcagttggccaaggcactgggcgtggcaacgcagattttcacttttatcgctgacaattctgagccggagagaatctaccgccgccatctgattcctaaacgggccgtcagagctcttccctccgtgccagtagaggatgccaggggaatcgttactctgagcctggatagcttcgacctgtcgaaatatcgggtggtttgggaggcccactctcccgtgatcaaacacgcacacaagtctgctgcccgggttctcgagagatatttgtcgcgtcccggagccctgttcccacatgaagcagcatttgggtacgtgaaagggcggtctaccaggcataatgcaaggaggcacgtaggcgccaagcgcttgctgagcgcggacatacaggatttcttcccaagtatcacgctcgcacgggtggagcttgctttagaagccgctggtttgcaaccggctgtgaccaatgccctgggccgatttttaaccattgaaggaagcttacctcttggtcttaatgcctcccccatgatcgccaatctggtggccactcctctagaccacgatcttagtgcgctggctaaagaatggggactcacttacacgaggtacgcagacgatattacattgtctggagacggggaattgccaacccgcgaaatcatcgagacagtgctcaagcgccatttctttcgcctgaacaaatcaaaattccgtaccagtaagctgggacagaagcattacgtgacagggctgtccgtcgctgataaggctgcgccacacgcccctcgtgccatgaaacacaagctccgccaggagctttattacatcgagaagtttggctttctggagcatctcagcagagggggtgagggaggtaccgagcagcacaacgtgaaccgtttggacggcacggtcaactatgtcagctccattgagccgagactagcacatcgcttgcgagccgcttggaagaaggtctgcgacgaaaacgacatcgccaaaagtttcgaacctcggccagtgattcagctgaggccagcctcttggtttgttgacgaggcggagattgtccatcccgatgggaccagacttctggcactctgcctggctgacgtgctagaacccgggagactcgatactgaacttaggacactctttgctgaagaagccggtgatgcctttggcaccgcggaccctctaagcatcatacagaagggcctccactggtccgatgccacatggagccagcgggaagccgtggttaagctgatcgcagcgtcccctgtacgggttatggtcgccatggcacctttaacaagcccctcagagtacaccactacatataccgacctgctgtgtgaaatcctggaaaccgccctgaagatagctgatgacgctgaaatagccatacatgtagaggagaatagatcaaaggtttctaaggcagacgtacaaggcgcagttactcgagcttatacagagctcgagacaaagaaccagcgacgacctctccaagcccccgaggtcaacattgtgtccaaaggggctaccccctgttgctgtgtgcccgatactgtcctcggcgctctgcacaggtacgccgtgagtcggaaagatggcaaagagggatcactggcagtcacactgttcgaaagactgcgcaaccactactccgtgatcttcgaccaccatgctaataaaatttaccaccacaggtcaccattcaagagatggtga

SEQ ID NO: 14267 - RNA, 1116 nt, unidentified
  source 1..1116: mol_type = other RNA; note = synthetic construct
atgggcagcgctcaacctggccatcaggcctgtccccaggtgtgcagaacagggacaggagctctgccattgccagccaggctccctgtgagtcacgaagccgcttttgggtacgtgaagggtcggtcaacccggcataacgcgaggcgccatgtcggagccaaaagactgctctccgctgatatccaggatttcttcccatcaattactctggctcgagtagaacttgctttggaggctgcagggctgcaaccagccgttacgaatgcactgggaagattcctcacaattgagggaacgctgcctctgggcctcaatgcctcccccatgatagcgaacctggttgcgacccccctcgaccatgatctgaatgctctggccaaagagtgggggctgacctatactagatatgctgatgacattaccttgtccggagacggtgagctgcccacaagggagataatcgaaactgttcttaagcgccactttttcagattgaacaagagtaagtttcgcacttccaaactgggccagaagcattatgtgactggtctgtcggtcgcagacaaagccgcaccacacgcccctagagccatgaagcacaagctccgccaggaactgtactacatcgagaaatttgggtttctcgagcacttaagtcggggcggagaaggcgcccctaactctaccacatcaattgtgtggatggcacggtctaccatgtacccagcctccaatcgggtgtggaggatcgactgtgccctaccaggcagacggtacgcaacacgcatgaccagtccgaatcacttatcacttggtccctctagcagctgtgatttgcttcgggggtctttaatgcgtcctcgctcctctatccgaatggcacacgggttcagcagatccgcgctccctaccttctggagcttggcaggttggatccagaactatggacgatgcagccctaaacgtcccgagatgaggagtggacagccgatccgctgcctgtcttcacggaggggctgcattggcgtcatgcgacacgggccctctgtacgtccatggtcgagccttagccccccccatctaagcggcagttggtccccgtggaggaggtga

SEQ ID NO: 14268 - RNA, 1788 nt, unidentified
  source 1..1788: mol_type = other RNA; note = synthetic construct
atgtccctcgataactacgtgccacagctgagccgcccttcttccgttgagcaattggctaaggccctgggcgtggcgacacagatatttacctttatcgtggagaatgacgaccctgaacgaatataccggaggcatctcatacccaaaagggctcctcggcgtttgccattggtccccgtggaagatgcggggggtatagtggaggtgagtctggactctttcgacttttcgagatatagaattgtgtgggaagcacagaatccggttatcaaagtggcccatcgcagcgcagctcgggtcctagagagatacctctcacgcccaggaagtcaatatccacacgaggcggcctttggatatatcaagggaaggagtacccgccacaatgctcgtaggcatagcggagctaagcacttgctgtcagccgatatcaaggattttttcccatctatcacgctggcacgaattgaactggctctggagcaggctgggcttaactccacagtctgtaacgccctcgccagattcctgaccatcaaggggagcctgccactggggttgagcgcatctcctatgatcgccaacctcgtcgcaacatcccttgaccatgacatcagcgctttggcgaaggaatggggcctatcttatacacgttacgccgacgacatcactctttctggagatggtccactccctgccagagagatcatcgaaaacattctcaagaggcattttttccggctgaataaggctaagtttcgcacctcaaaaaaagggcagaaacactatgtaacgggcctctccgtggctgacaaagtcgccccccacgtgcccagagttatgaagaggaagctgcggcaggagttgtactatatccgaaaattcggttttcttgaccatttaagtaggagtggcggtcgaggcactgagcaacacaatgttaatcgactggacggcactgtgaactatgtatcaagcattgaggccagctttggctacaaactgaggagcgattggaaaggcatttgtgaggataacggaatttcccgctccttcgagcctcgcccagtgattaaccttaggcacgcctcatggttcatcgacgaagcagagataattcacccggacgggacacggctattagccctctgcctcgcagatgtcctggaacacgatcggctcaatgtggagctggtgactcttttcgctgaggaagctggggatgccttcggtactgcggactccctttccattatccgtaagggacttcactgggccgaagcgacgtggagccaaagagaagccgttgttaagctgctggctgtgtcccccttcagagcaatcgtagccgtagcacccctccccaacccccaggaatattctcgggtgtatacagacctgttaaaacagattctggccactgccctgaaaaccagcgatgatgccgcagtcaatatgtacgtggaggaaaaccgcagtaaggtggccgagtctgaggtacagattgctgttaagaccgcttactttgacctggaagagaaaaaccagcgacggcccttaaagctgccgtgcgtcaatattgtgcccaagggggcaaccccttgctgttgcgtccctgatattttattgggcgcactacatcgctacgcaatatcgaagaaagtcgatgccgagtcaggactggccgtgaccctctttgaacggctgagaaataggtactcagttatcttcgacggccacgctgagaaaatctaccaccatagaagtcctttcaagaggtggtga

SEQ ID NO: 14269 - RNA, 1716 nt, unidentified
  source 1..1716: mol_type = other RNA; note = synthetic construct
atggctaggcagatctttgagttcattgctgataatgagaatccagaattgatctaccggagacaccttattcccaaaagagccgcaaggcctctgccgtcggtacccatcgaatccatggatgggggtgtggagttttcactcagcggattcgacctttcgaggttccgggttgtgtgggaagccgagaatcctgtgatcaagcatgctcacaaaagtgcagccagagtcgtagaacgttttttgaccaggccaggcactggctttccacactccgccagtttcggctatgtcaaggggcggagcacccgtcataatgccagtcaacatataggtcgcaaatacctgcttagcgccgatattaaagacttctttccatctattacggcagcaagggtccagctggccttagaggaggccggtctaaaggccgttgcggcagaggcactatctcggttcctcaccgtgcagggctctctcccgcttgggctgaatgcctcacctgtggtggctaacctggtcgcactcccactggacaaggagctcgatgagtttgcaagaaaactgggactttcttattcacgctatgctgatgatgtgaccttgtctggggaccagatgctgcccagcaaagacgaagtggatcagattttcaagaggcatttcttcaggatgaatcgagtgaaattccgcacatccaagcgcggccagaaacactacatcacaggactgtccgtcgcggacaagttcacaccacacgctcctcgagctatgaagcaaaagcttcgacaggagctatattatatagacaagtacgggtttagcgaccacatctcccgtagtaggtgcggtggaactgagcagcataacgtgaacagagtggacggcatggtgagttacataagttccgttgagcctcgccattcatacagactccgcctcatgtggaagcggctgagaaccgcgaataatatcgagagatccttcgaacccaggcctgtgatccggtttcgacaagccagttggtttgtcgatgaagctgaattcacgcacccctcaggggtcccgcttttggcagtgtgtctggcagatgtgttggatagcgcccgcctggatgaagtgctcgccagctttatcgaagaagaggccggagatgcttttgggtctgtcgacgaggtcagcatcgtgcggaaaggcatccactgggtagatgccacttggtcccagcgagagggcttagtcaagatcctagccgaagcgcccattagagcaatggtcgccttcgctcctctgcggaacggcgaagactactcaaaggtttatctggctctgttgcgcaaaattctcggtacagcgttgaaggttgccgatgacgccatagtgaagatttacgccgaggaaaaccgctcaaaagtccgcaagtccgacgtagttgacgccgtgtcgtctgtgcatagtatgttagcagacaaaaacgagaggcgacctctgaaggtacccgaggtgaacgtggttcccaaggcttttctcccatcttgttgcgttcccgacgccttactcggcgctctggctcgttacgcgacttctaggtctgagtccgaccggggaggactgagcgtaaccctgtttgaaagactgcggagcagatattccctgattttcgatgagtacaactcaaaagttttccacagcaggagcccatttgtgcggtggtga

SEQ ID NO: 14270 - RNA, 1788 nt, unidentified
  source 1..1788: mol_type = other RNA; note = synthetic construct
atgtcacttgacaatttttaccctgacctgactaggccatcgacagtgccccaactcgctaaggctctgggggtgccactggatattttccagatgatcatggattgcagcgacccgagtctgatatatcgtcaacactttatccccaagaaagtctgctcgatcatgcctggcacacccgtagccaactcagatggcacgatcgaaatagtgctgcctaatcatgacctcagtcggtatcgcgtcgtttgggagcctaccaacaacgtcgtgaaatttgcacacagatctgcagccggcgttctcgagagattcgtgtctagacccaatagccaggctgtgcatccatgcgccttcggatacgtgaaaggtaaatcaacccgtaagaatgcccagcagcacctgggaaaatatttcttgctcagtgcggacataaaaaacttcttcccgtctgtgagcgtggcaagaattgaggttgctttacgcgtgattggcattaaggacgaagtcgtcgagtccttagcgaaatttttcgccattgaaaacagtctgcccttaggcctcaacgccagtcccatcatcgctaacctggtggccaagcctctggacgaggacttgctcagtctcgcggagggatttaattgcagctacacacgatatgccgacgatttgaccttttcaggaaatgagtcacttcctaaaaaggaagacatcgagtttattctacggaagcataggttcaaggcaaaccagagcaagttccgatactccaaaagagggcaacgccactacgtaaccggactgtctgtagctgatgtgcacagcccacacgcaccgaggaaaatgaagaagcggctgcgccaagaactcagattcattgagaaattttcactggacgatcatttcagcaagatcaagaagagcggcgagcgacagcacgaaatcaatcgcatcgatggcactgtgtcttacgttgcctccatcgaacggaaactaggggccgacatcagaatccaatggaaggctatttgtgataaagaacaggttggccggtcctttgaaccccggcccactacccttttgaggtccgcggtgtggttcatagatgagacagagtttgacgccagggacggtactaagctgctagctctctgtctggcagacgtgctggacccacagcggctaaatatagatctgttgaccctgttttcagacgagtctggtgatgcctttgggcttggtgccgccgccggaaaaatgattcatgacgggttacattgggttgatagcaatcttacacagcgagagaaggtagtcaatgtcctgtctatctccccaattagggtaatggtggcaatggattccgtggaaggggctacttatcagaacgtctacctggatctgctgcggaggcttattaacgttaatctccgcggagccgacgacgcaagagtgcatattgtcatcgagagtaacaagtccaaggttcctagacaactggtcatacaggcggtgcgagacgagtgtgcccttctcgaagctgccaaccagcggcgtcctctggagatccctagcatcaacgtggaaggtaaggattggacgcccgctatgtgtgtcccagatgtgttcttgggcgtgcttgctcagtacgcaaactccaagcagaaagggcagggagaatttatcgtaagcttaatggagcgcttgcgtaataggttcgcagtcgttttcgatgaacacgagggcgcaatttatcactctgggaatccattcaggcgctggtcctga

SEQ ID NO: 14271 - RNA, 1512 nt, unidentified
  source 1..1512: mol_type = other RNA; note = synthetic construct
atgaacatcgatagattcatccacgctcatgcccctagttttatccacgagaacgcttatggatacataaaatacaggtctaccagggctaacgcttctagacataagggagccaagattatcgtgagtgccgacataaaggaattcttccccagtataagcattggacacgtggagcatgcccttcgaaaaaccgggatgaaaaaggaaacagcttccctgctcgccaagtttctgacaattaacaatagcctgcccctggggttgaatgcctctccaacgatcgcaaatctagttgctaaccctattgatatagaattcaccaatctggctaagcgaattaattgcacgtataccagatacgctgacgatctcacattttcaggcgacaatacacttccctctcacgacgagatcaacgggatactgggcaaatttggattccgctcaaatgagcgcaaatttagggcgtcaaaacggggccaaaagcactacgtcaccggtcttagcgttgccgaccctaagcagccacatgtgccgcgcggactcaagcgtaaactccgccaagaattgtactacattcagaaatacggtctgaagaatcatgtggaaaagtctgactccgaatcaactcagcggatcatcaaccggctggatgggacaatcagctacgtcactagcgtcgagagtcagctcacaagaaaacttcgatccgcatggaccagcatttgtcaaaccgagaaagtcggccgctcctttgagcctaggcccctccacatcctgagggatgcatattggttcatcgacgagagcgaaattccgcgaccagacggctccacctgtctagctctctgctgcgtggaactcagtgcaaacaccatccaggcagatgaagcatctctgactagcctgatcgagaaggaaaccagcgacgcctaccaaacggccaaatcgagcctgcactgggcggagtctacattgtcccagcgtgagaggatcgtcgatacattaatgccaagactgttctctacttttgttgtgctggagaatctctccgacgaaccatacaaagatacttatattcgggcgttgaagctggtaatcgatcccattttacggagaagtgatgacgcaatcgttgaaattatgatcgaggccaacccatcgaagatttcacagcagtccgtaacatcctctattaaggacagttatctgagactggtggagttgaacgagcggaggcccgtggaaatgcccaagattagagtggagaaaaagggtgccaggcctgcgttactgttaccggacatcatgctgggggccctttccacctatgccaagtttcagcctggctcaaactcgacccttgagtattcattcttcgaaaaactacggactaagtatacgatcattatagataccgccgagaagaagttgtaccaccgtaaaaatcctttcactccctggcatactcgcaacaatacaaagatacagccaagcaaagcagagtga

SEQ ID NO: 14272 - RNA, 1722 nt, unidentified
  source 1..1722: mol_type = other RNA; note = synthetic construct
atgaacaccgctccacctggatctcagcagctgtttagactggcggacgtgcgaactatcgaccagcttgctagggccctgggtgttcccttacaaatttttcaggatgtgatcgcctgtgaggatcctcagcagatttatgccctccatgccattccaaaaagacacccgagaaatcccgaagactaccggatagcttgggagtgccgacaggaaccagtggcacggagccataaggctgtcgcaagaagactggacgatttcgccaggcgccgcccgatatcatacccccatgccgccgttcatggatatgtgcggggaggtagtacacggtccaacgcacagcctcactgcggtgcaagagtcgccatcagggccgacattgaaaatttcttccctaccattacactggaacgaattgaagctatgctaaggaccatcgggatgcaagccgcacctgcgaaggcacttgcccgcttcgtcactattaagggggcgttaccgctgggattggcggagtctcccgttatcagcaacttagtatgtctgggcttggataaagacttgcagtccctcgccgaagagcgtggtgtccgctatacacgctacgccgacgatatcactttttctggagatgccaaccttcccagcagggagcaactccgggcaacacttgcaaagcatgggttcagactgagtgagcggaagttccgcaagagtaagcgcgggcaggctcacttcgtaacgggcctttctatcagcgaacgggattacccccacgtgccaaggaagctcaaacgcatgctgcgaatggaattgcacttctgtgaaagatttggcataggctttcatgccgagaaaatcaatgaggactttcgaaaaacgtacttgcgcctggagggaatggtcaagtacgtggcgtatatcgagcgcagaaagtcaaaagaaatcaacgaccagtggcaaagggtcctggccgttcacagaggcccaacttcccacgcaaagatagagagcaggaaacgggatgacaggtttgtaattgctgatgagacagagtttaccgtggatggcgtgaaatatctggccttttgctgcgtgcggattgctaatctggagagggtggaagaggcaatccagatcctcctgggcgactatctaactaagcccggggccaagggcgatctggacgtgttgcaggcagtgggcattcactacaccgacgcccacttcgatctgaggaccaagaccctagaccttatgaccgacttcttatcttggagcgcatccatacactttgcccggctggactcatcatccaaatacaaagacacatacctgaaattgttcgctgactccattcgccaggagctcatcacatcagatgagtggacacttcatatcctcgtggagcgaaatgacaaagtgaagctcccctccctcaccagggtcatggaagctgaatatcaacgagctgctaccgatggcgctcgtcggcctagctctctcccatcggtgcaaagagtcgaaaaggcgagtactagtagcctaaccctgcctgatttcgtgctggccacgtttagaaactacgctcagctggtaccagatgaccgtgttctcgacttcgagagaatccgtgaccgggttaggtatatacatgatgccgatcggggggtctactatactcgtaagaaaccctttgtggggattggatcggcttga

SEQ ID NO: 14273 - RNA, 1725 nt, unidentified
  source 1..1725: mol_type = other RNA; note = synthetic construct
atgacgactgtttccatgcagccatgtgcacattttagactcgctgacgtgcgaactgtagatcagctcgctcgagccctgggagtgcctctgcaggttttccatgaagttatcgcgtgccaggaccccgggcttatttacgctatgcatagcattcccaaaaggtcgcagaggaaccccgatgggttccgcgtggtgtgggaatctcgcacggaagccgtcgcgaggtcacacaaagctgcggctagacggctcgacgacttcgcaagaaggcaggaaatcggctacccaaaccctgctgtccatgggtatgtccgcggagggtcaaccaggtctaacgcactaccgcattgtggtgcccgggttgtggtgagggccgatatagaggattttttccagactatcacgttggagcgtgtcgagagcgcctttagagccatcggtatcgctcctgaaaccgcccatagtctggcgctgttctctactattaatgggaaacttccactgggtctgccagagtcccccgtggtaagcaatctggtctgcctcgatcttgaccgggatctgaaggccctggcagaccgacacggtgtcaaatatacaaggtatgcggacgatatgaccttctcgggcaatgagaacctcccttctagagaagagatccgcaccgtcttactaaggcacggctttcgtctttccgatcggaaatttaagaagagtaaacgagggcaagcccacttcgtgactggactgtcagtatctgaacgcgactacccgcacgtgcctcgtaaacttaagagaatgctgcgtctggaactgcacttctgcgaaaagtatggcctggcaactcacgctgagaaccggcgagagagcgaacgcaagacctatctgcggattgacggcatggtgaattacgtgagcttcatcgagcgccggaagtctgctgccatcaaaggccaatgggataggatccggaagaaacacctgggctcaaccttgtacgctagattagccggcaaagaaataggagatcggtttgtggttgcagacgagacagagtttgaggtggacggtatcggctacctagccatctgttttgtacggttgagtaatttggaggacgtggagaaatccctggacctgctcctcggagattatctcaccaagccaggagccaaggggaatctggatgttttaaagaaggtgggcattcattacgcagacgcccactttgacttgcgcacaatgaccctggatctcatgactgagtacttgcagtggagcgcaagtatttgtttttcaaggctgcggacaagcgacgattataaggaagcatatttaaggatgttcgcagaactcgtaaaacaggagtttgtgacctctgacggccttagagttgagatgctggtcgaaaacaatgacaagattaagttacccgcacttacacaagtgtgcgaggccgagtatagacgatccgaaagtgaggacggacgccgcccaatatccctgccctccattcgttccgtcaagaagagcgagattcgaagtttgacacttgccgattttgtgctcgccgccttcagagcttacgtgctgcgggctcacgacgatagagtcctcgatttcgaacgcataagagacagggtgaggtacgttagggacagcgactcagataacttctacacaagaaagaaacctttcctaggaatcggggatgtcacctga

SEQ ID NO: 14274 - RNA, 1269 nt, unidentified
  source 1..1269: mol_type = other RNA; note = synthetic construct
atgctcccagcgcgccttttggccaaatttgttactattaacggcctcctgccccttggactgcctgagtcccctatcatttccaacctggtatgcctggacatggatcgggagctgcaggctatggccgatgagagggatctgcgttatacacggtacgctgacgatattaccttttccggttatgcaaaccttccctcaaaagaggatattaggcacttgctcacgggacagggcttccgcctatctgaccgcaagtttaggatcagcaagcggggtcaggcccacttcgtcacaggattgtccgtcagcgagcgcgattacccccatgtcccgcgagaaatgaagaggaagctgcgccaggaattgtatttctgtgaacgatttgggctagacgtacacgctatcgagcagggtgaaacctctcagaagacattcaataggctctacggccttgtcaattacgtgagttacgtagaaagaagacaggcagaccggctccatcagaaatggggcaggatcgtgcgtagagagctgggagaggctgcctacgctactgtgcagggccgggagtaccgagacatacacctgattgtggacgagagcgagtttaagatcggggaacaaaagtacttggccatatgcgtggtgaggctctctgaattagacagaaagcaaagagtggtgcggaagctgttactagattatgttacgaccctcggagcaaaaggggaaattgatgctttgaaagatgtgggagtgcatttcaccgaagtccattacgacctcagaacaaaaaccctggatctgatgctcgagatgttatggtctgcgagcgtccattttgccaaatatgagtcgggggaggactatgagttcacctggcttaagctgttcaaagaagcaatgcaccaggaactggttactgccgacgggatcggcctcgaggttctggtggaggaaaacgacaaggttagttccagtgccctgaagtcaattgtagacgcccagtaccaacacatggagcttgcgggctcacgacgtccacgcgtgaagcctgatgtcaagcgggtggggaaatcagatactccaatcctgactctgcccgacttcgtgctggccgcctttcgacataatgtgcttcaagtcgcagatgaaagagtgctggattttgaacggataagagacaaagttcgctatatccacgatcacgacttagacgcattctatacaaggaagaaacctttcgtcgaggtgggcagcgcttga

SEQ ID NO: 14275 - RNA, 1770 nt, unidentified
  source 1..1770: mol_type = other RNA; note = synthetic construct
atggcgcgagatcctgtggcaccctttattgtcgacttccggaaggctaaagatactaaccaccttgcaactctgatcggatgccatgccgagatgctggaccgaatcaggaattccgccacacaccaagaattctatcgggaacacagaatcccaaaaaggaatcggagacgtcgtggcgagtaccgcgtggtgtggcaagcagtctccgagctcgcccaaattcagaaggccctcctaagaaagttcgaaaatttcgcacgcgacactgttgatgactatccgcatagtgctgtgcacggctatgtgacagggagaagcactctgacgaacgctcggtgtcatgctggagccaaaatcattgctagggccgacatcaaggactttttcccatcaatatctagagcacggttggaagcactccttactgagcttggcatctaccagtcagtggccgaggttatcggaggacttgcgacgatcgatgatggcctgggacaagggatacacacctcgcccttcttcgcgaatcttgtgtgtattccactcgaccaggagttgtctgatctggccggtaagtaccaagctatctatacccgatatgcagacgacctaacgtttagtagtgatacacgcgtgccggacagaattgccatcgaaacagtgctgcagactcatggcttccccctggccaaagataagtttcgaacaacaaaaattgggcaggcgcactttgtcactggactgagcgtttctgagctcgatcggcctaggattccatataagttcaagcataagttgaggcaggaactctattactcagaccgttttggaatcatgaaccacgctgagagagccgggtacaggttcccccaccactgcattaactcgatcgatgggcgcatatcctacctgcagggaatcgagcctgagctcggggtggaaatgagacagctctggaaaagccttctcaagcgagatggcttattctccacctacttgcctacctataaagagggcatgcgccagatatttaaggaggttgagggcgtatcatacttcattgatgagacagaaacccattttaggggcgatgtttatctgggtctagcattagtagccgtcgccaccggggatgtgtctaccattgaggaggctatagcacagacattggataggttcctgcatgacccctacgctagcggtaggaaggaaaagctgcagaagaaagggctacattttactgacgacagtgaagagatacgtaccgactttatcaaaactattgcccggttccccatcagagcctttgtggcctatcggaaactgtctgggatcaccagaaaggacgcctacctgtccctgctgaggattctggtcacagatcgcctcagcgacccattgcttaccctgaacagcacgatcatatacgaacagttgagcgaagtcccgcacaagtactttgagctcaccattcacgaagtaatgggcaagattaaggagcgcggtggcaaattctatcaggagccaaggattgtatgctgtggtaagcgggatcagccttgcatcgctatcgccgactacctgctgggtgtgttttcccactacgctacctccgagccccctaacgaaacccctaggaaacgcttcgaacgcctgcgggacaaaattcggttaatcgtcgacgctgacgagaaacgacgcttttggagaaataacccatttcccggcttctctgcaatggatggaacagaaaataatttagcgtga

SEQ ID NO: 14276 - RNA, 978 nt, unidentified
  source 1..978: mol_type = other RNA; note = synthetic construct
atgaccaccgcaaagctgagggatctgaagtctatagacgatgttgcacgggcctgcggagtggaagccgactttatcgccgaatatgcccagagcgagtatcagagccatttctacaatttcctcaagctcccaaagcgcggcaagcggaggaaaggagagttccgcgttgtgttcgctgcgaaagaggaacgtttgcgggcgcttcacagatctatcagcatggtggtaacaaattccgctaagtttggcaaccacgtccaggggttcatgaaaaaaagaagtactagaaccaacgctgaacaacacttaggcgcgaaagtgctactgcatgctgacatcaaggggtttttcgactctattactaccaaacacgtccgcgatgcctttatttcggacggtacagacgttagcgtggccgagctgctagcctccgcttgtactattgacggcctgctgagacaggggaccagatgctcacccacaattgccaacttggtttgccatgatatggaccaggcatttcttaggttggcacgagctcatgactgtgtgtatacgaggtacgccgatgacattactttctccggcgagtccgtcccgagtgatgatgcagtccagcagattctcgaatcacgcggttttgaactgcgcgatgggaaatgttaccgccaataccggggtagatctcagtttgtaacgggactcacaatcgccgacaagagtgcccctaggctgcctaaggctttaaaacgacgtcttaggatgataatgcactatatagagaagttcggaatcgcagaccatttcaaacacgctggcgtgtttgatccctatagagaagaagcctggctccgagggatactgatttatgcacggtccatcgagccagagctggtggagaagtggcaagagatcctggataggtcaatctacgaccggagcgattacgatgagcccatcgacgacgattactga

SEQ ID NO: 14277 - RNA, 951 nt, unidentified
  source 1..951: mol_type = other RNA; note = synthetic construct
atgaagtcgattgacgacgtggccagggcatgcggagtagaggcggacttcatctctgagtatgcccaaagtaaataccagaaagactactataacgccttgaagcttgccaagagaggcaagcgaagaaagggtgaattccggatcgtctttgccgcaaaggaaaaaagactgcgcgccctgcatcggtccatttccatgattgtgaccaattctactgagttcggaaaccacgtccagggcttcatgaagaaaaggagcactcgcactaatgccaagcaacacttagcagctaaaattctgttgcacgctgatattaagggcttttttgatgccatcaccacccagcacgttcgcgaagcactgatatctgagggagcggctgtccctgttgctgagctgctagctaacgtttgcaccatagacgggcttctacggcagggaacaaggtgttcacctacgatcgctaatctggtggggcatgacatggatcaggccctgctgaggctggctcgagccttcgactgcgtatacacgaggtacgcggatgacatcacattcagcggcgcctccgtaccaagtgatgacagcgtgcgtgaagttctcgaaagcagaggcttcgagcttcgggacgccaaatgttttcgccagtaccgtgggagaacacaatttgtgacaggtctgactgtggtggatgaaaccgctccaaggcttcccaaggggctcaaacgacgtttgcggttaatcatgcactacatagagaagtttggcatcgtggaccatttcaagagagtgggagtctcagatccctatcgggaggaggcatggctcaaaggtatcttgatgtatgcacgctccatcgaaccccagctggtggagaagtggcagaaagtcctcgatgacgcaattagtgaacatccgccttatgacgatctcattgatgacgattga

SEQ ID NO: 14278 - RNA, 993 nt, unidentified
  source 1..993: mol_type = other RNA; note = synthetic construct
atgacaataagtaagctgcgggagctgaaaactatcgatgacgtggcccgagcctgtggcgttgaggcagatttcattacggaatacgcagagtccccggagcagagtacctattatgaagctctgaagctcagcaaaaagggcaaacgccgatctaatgaattcagaattgtctttgctgcgcatgaacagagactgaaacagctccacaggggcctttctatggtcgttgctaactctgccaatttcgggtggcacgtgcaaggttttgtgaaaggacgttccaccttgagtaacgccaaacagcacctgggcgcaaaagtgttgctccatgctgatatcaagtcattcttcgacgcaattactgtggatcaggtgcaagctgcctttgtcgagcatggtgtactggctcccatggcggaggttctagctaagttatgcacaattgacggtctactgaggcaggggacccggtgctcgcctatgatcgcaaatttagtctgtttcgatatggaccaggcctttcttaggctggccggggcaaccaacagcaattacacccgctacgccgacgacataacattttcaggagatagcgtgccctccgacgattcagtaagaactatcctcaagaatcgctcctttgaacttcgggacgggcggtgcttcagacagcatcgtggcagagtgcagttcgtaactggactgagcgtggctgacactacagcccccaggctcccaaagcgcctgaagcatcagcttcggttggtgatgtactttataaagaagcacggcctggacgatcacaacaattgggtgaagcaaggatataaatctcaccctgagatcacctggctctgggggatcttgaactacgcgaaaagcatcgaacctacgctggtcaaccaatggcagcaggtttatcagacagcctgggaggaacagcaagccaagcgaaaggagaggattaaggtcaaagattggaacccatga

SEQ ID NO: 14279 - RNA, 1041 nt, unidentified
  source 1..1041: mol_type = other RNA; note = synthetic construct
atgtcaagcaacccgtacattaaaacccttttgtatccttcccgccgatgtaggccttacatgacgatagccaaattgaaggagctgaaaagcctggatgacgttgcccgagcttgcggagtggaattcgatttcatcgaggcctatagttccagccagaatcagaaatctttcttcaatgtgctgaagctgcccaaacatggtcgccgaagaaagggtgagtatcgcattgttttcgaagcccgggaacagcgtctagcagcctttcaccggtccattagcatgattgtgaccaactcagcggtgttcggggagcatgtgcagggcttcatgaagaaaagatccactcgtactaacgccgaaaagcacctggcagctaaggtcctgttgcatgccgatataaaggggttttttgacgccatcactaccgaacaggttagaaatgctttcgtgaccgagggggccgcagtaaggatggcagacgtattagctaaggcctgtacaattgatggactcctaagacagggaacccgctgctctcccacaatcgctaacttgatttgctttgacatggaccaaagtttccttcgtctggctcatagccacaactgcgtctatacaagatacgcagatgaccttactttttcgggcgatcaggtgccatctgatgacagcgtcaaggagatcctcgagagtaggggatttaagctccgcgatgatcaatgttacagacagtacaggggcaggtcacagtacgtgacaggcctcaccatcgcagacccaaatcagcctcggctgcccacacggcttaagaggagactccgcctcatgatgtattacatcgacaagcacggcttagctgaccactggaggaaagtaggggtcaatgacgtgatacaggaagaagcctggctgcggggcatgctgaaatacgcggggtcaattgagcctaaactggtcaaccaatggtggcaaatctttggtgaggcgtggtccaaccggacgtcttatgagcccatcccaggaaatgaagagcactga

SEQ ID NO: 14280 - RNA, 987 nt, unidentified
  source 1..987: mol_type = other RNA; note = synthetic construct
atgacgactgccattctgaagaatttaaaaagcttggacgacgtagctcgagcgtgtggaatcgagcgggacttcattgaagcctactcaaattcactggaccaaaagagcttttacaacgtcttaaagatccggaagcgtggcagacgacgtaagggggaattccggatcgtttttgaagcccgggagggcaggttggcgagtttccacagggcactcagtatgattgtgaccaactcaaccgtctttggcgatcacgttcagggtttccttaaaaaacgctctacacggactaatgctgagaagcatctagcagctaacgtgctcctccatgccgatattaaagggttttttgacgctatcacgactgagcaggtgcgaaacgcacttgtggccgagggaaccgccttgcctatggcagacgtcctgtccaaagcgtgcaccatcgatggcctgctgaggcaagggactcgttgttctccaaccattgccaacctcgtttgcttcggcatggatcaggccttcctgcgcctttctcgatcccacaattgcgcatacacaaggtacgctgacgatctgagtttctccggggacgaagtgccatctgatgactccgtgagggagatactggaaagctgtggattcaagctccgccatgatcagtgctatcgccaatataagggtagaagccagtacgtgacaggcctgaccgtcgcagaccccaatagacctcggctaccgaaacgcctgaagcacaggctgaggttggtcatgtatcatatcgagaagcatgggctcacagatcactggaataaagtaggagtggatgaggccctgagagccgaggcttggcttagcggtatgctcagatacgccggatccatcgaaccccacttagtgagacagtggcagcagatatttgacaaagctcgctcgaacagagatccttataagcccctgccagactgtgatgaaggtcagggctga

SEQ ID NO: 14281 - RNA, 984 nt, unidentified
  source 1..984: mol_type = other RNA; note = synthetic construct
atgactaaagcaaagcttaaggatctcaccaccctggatgatgtggcaagagcttgcggtatcgaacctgacttcattctcgggttcgtcaaaaacacaatccagaaggactatttctacgttgtgaagatggcaaagcggggacgccggaggaaaggcgaataccgcgtggtatttcaggccagagagaagcgcttatccgattttcatcgctccatcagtatgatcgtgagcaattctgcttgttttggcgaccacgtgcagggctttcgaaaaaaacattctgcccggacaaacgctgaacaccatctaggcgcggccatactgctccacgccgacattaagggattctttgatgctatcacgactgcacaggtcaaaaccgctttgatttcagaaggctccccgcctcctgtggccgagttaattgcgaaagcgtgtacaatcgatgggttccttcggcaagggacccgctgctcaccagtcctggcaaacctggtatgtgtggccatggaccagagctttctaagactggcccgtagtcacacctgcaattacacgaggtatgctgatgacttgactttctcgggagagagggttccctgtgacgaggccgttagggaaattctcgccgctgatggcttcgcacttcgtgatggaaagtgctaccgacagtttagagggaagacccaatacgtgacaggactgactgtcgcggatccaaacaggcctagactgccaaagcaactgaaacatgacctgaggacaacaatgtatttcattgagagacacgggcttgccgaccactgggagcgaataggtgaggagcatcccatgaagaaagaagcctggttgcagggcatgctgagatacgcctggagcatcgagcccaatctcgtccgcaggtggcagtatattctggaccgggctttcactgaacgggcaccctatatcatagacatcaccgatgaggactacggttga

SEQ ID NO: 14282 - RNA, 1104 nt, unidentified
  source 1..1104: mol_type = other RNA; note = synthetic construct
atgatacagagtgcacttgctaccgtcgttgacttctctgggtacgtccgtggccgcgattctgcggtgaggtcattggagaacttcctgtatcccagcaccgtggctacagatatgacacaatcccggctgagcgaaatcagggatattggggacctcgcacgcgccactggaatacctaaagactttattgccgcctacgctaattctcaggcacagtccgatgcttactcagtcgtgctaattcctaagaaaggacgaaaaagaagaggccactttcgggctacgtttagcgccaaccaggagtggcttagtcagctgcacagaggcgtggccatgattgtactgaattccgtcgactttggagaacacgtgcagggatttatcaagaagcgttccatcaggactaatgcagagcatcatctgggcgccaaacagctccttcatgcagacatcagcaactttttcgactctatcaccactaaccagatcactcaaaatctcataacggtaggagcagccccagaagcagccagtttaattgccaagtcatgcaccatcgatggcctgctcagacagggcactaggtgcagcccgattctggcgaatctcgtgtgccggtctttggatgctgatatgatcagtctggcccagtccattggggctaagtataccaggtatgccgacgaccttactttctcaggtgatcagacaccctcaagcgacagtgttgacgccataatcacccagcacggtttcacactgagagatgggcggtgttacctgcaacaaaaaggccatcgccagtatgtgacaggtttaaccgtggcagacacagcccaaccccacctaccaaagcgcctgaaatctcggttgcgcctggttatgcattacattgaaagaaacggtgtccgagctcacttcgcccacgactgtaaacgacctatcgcccgaaacgcaaatgagctgtgggggatgttgaggttcgcgaagagcattgagccagatctcgcttcgacctggcttgaccagtggaaggcgggagagagaatcgattcctccaaggaacggcgcaggctcaaaaagctggctcgttggttatga

SEQ ID NO: 14283 - RNA, 972 nt, unidentified
  source 1..972: mol_type = other RNA; note = synthetic construct
atgacccaaagtcgtctgagcgagctccacgacattgtggatctggcccgcgccactggagttcctgctgaatacatcgattcgtatgctaatgaggcaacccaagctgacgcataccatgtcctccgtatcccaaagaaaggccgaggacggcgaggacagttcagagtcgcattttccgctaaggaggagtggctagcccagctccacaggggtattgctatgattgtggtgaactcagtggagtttggtgaacacgtgcaaggcttcttaaagaagcgctccatcaagacaaacgccgcccagcatttaggagcgaagcagatactgcacgccgatatcagcaatttctttgacgctatcaccaccgaacttgtgtctgaatcactggtgacagtcggcgtcccccccaagatggcagttctgatcgcgaaaagctgcactattgatggcttgctgaggcagggtacacgatgtgggcctgccctcgccaacctggtttgtcggcctctggatgccgatatgttgagtctggcagctgccacaggagcgaaattcacgcgctacgctgacgatatcaccttctctggcgctctcctaccaacgggcgacagcgtaagggccatattgaataaacatggttttgcgttacgcgacgacaggtgctacattcaaagaaaggggagatcccagtatgtcaccggcctgactgtggtggacactgtacaaccccatctgccgaaaaggctcaaagctaggcttcggctcgtgatgcactatgtggctaagaacgggctgcaggcattgtttgcacagcaccatgatagacccatagcccagtcagaatccgagctgtgggggatgcttcggttcgccaattctgttgaacctgccctggccgcaaaatggtttgcccagtgggaggcgggggagcttgtagacgcacagagaggaccaaagcaggccgcatga

SEQ ID NO: 14284 - RNA, 999 nt, unidentified
  source 1..999: mol_type = other RNA; note = synthetic construct
atgactaagactaagttagttgacttgaaaaccctggagcacgtagctcaagcttgcggagtgtctgccgaatttatcgttcaatacgcaaatgatcaacggcaaagagattactacttcaggataaaaatccctaagcgtgggaagaatagaaatcgccagtttcgcatcgtcttccaggcgaaggagtaccagctggcttcactgcatcgctctgtggcaatgataatcgccaattccgtgcagtttggtgaacaagtccagggcttcagaaaaaagaggtcttcccggtccaatgcacagcagcacttggccaaagccgtaatcctccacgctgatattaagagtttctttgattccatcaccacagaacaggtgcacgtggcgtttgtgtcacagggcgtgtcgaacgagatcgcccagctactggctaaggcatgcacaattgagggccttctcaggcagggtacccgctgtagcccaatcctagccaacttggtctgtgccgggctggataacaagctgctggcccttgcacatagctgccattccgtcttcacaaggtatgcagatgacctcactttcagtggcgatcaggtgccctctagcgccgcagttaagacgattgtcgagagcgaaggattcacactcagagacgacaagtgtaaactgcagcggcagggacggtgccagtatgttacaggtttaaccgtaagtgacggcaacatgccacgtctccctcgacgcctgaaatcaagactgcggttgattttccattacatcgagaagaatggactcaccgaacactggcaaaaaactgggcagaaaaacggccgaaggaaagagcagtggcttgacgggatgctgcaatatgctgctagcattgagcccgaccttgccaacaagtggcaggacattctgactaccgccaaagtgcagaaagctgccacggcgcgacagaagtattttgtggactgtgggatagatgatattgactga

SEQ ID NO: 14285 - RNA, 927 nt, unidentified
  source 1..927: mol_type = other RNA; note = synthetic construct
atgacaaccaccaaactcttagacatccatgaccttgccgaactgagttatgccgtcggagtccgagcggagctgatcgaagagtatctgaccgcgcccaggcaggtagactactacgaggtaataagaatcgccaaacgcggccgcaacaggaaaggcgagtacagacaggtttacaaggctaagtcaaactggctgtcacaattgcacaggtctatcagcatgatcgtaaccaactcagtggagttcggagaacatgttcaggggttccttaatgggcgtagcacagttagtaacgcaaaactacacatgagaaaagatattgtggtccacgctgatatcaaggatttcttcaatgcaattactgaggcgcaggtgtgccagtccattatgtcgctcggatgtgcccagtttattgcctccataattgcccgggcatgtactatagacgggcggttactgcaggggactagatgtagccccgtgatctccaatgtcgtgtgcagaaacctagatctggacatgctggaactcgccagggctacgaagtctaccttcagccgctatgctgataatatcacgtttagtggtaaggctccgcctaacaaggagaacatcgaggccgtggtcaatgccaggggctttatactccaacccaagggatgctacgtgcagtatcggggctcccgccaattcgtgacaggtctgtctgtggttgatggcgttatgccacgattgcctaaacaagtcaagaagaaacttcggctgattgcatactacgtgaagaaatatggtgacggccacttcgagtttagcagtggaaatcactctattgcacctactcgtacacagctcgaagggtttatcgcttatgctcattccgtggaaccagaatttgccaagaaattgtggagcatggtgtcatga

SEQ ID NO: 14286 - RNA, 927 nt, unidentified
  source 1..927: mol_type = other RNA; note = synthetic construct
atgaccacaacgcgtattgaggacgtgcacgatcttgctgagttaagcttcgctgtcggtgtcaaggccgaattgatcgaatcctacctgaacgccccttggcaggcccatcactatcagattatcaaaattgcaaagcgcggccgcaataggcaaggggagtaccggcaggtgtacaaggctaagaataaatggctcgctcagctgcacaggtccatcgctatgataatctcgaactctgtcgaattcggcgagcatgtgcaggggtttcttgctggtagaagcaccgtatccaacgccaagctgcacatgaagaaagacgtcatcgttcatgccgatatcaaggacttcttcaatgctatcactgaggtacaggtgtgccagagtatactggcactggggggaaacctactcatagcccagatccttgcccgggcttgtactattgacggatatctcttgcagggaacacgatgttcaccagtgctgtctaatattgtgtgcagacgactggattcagacatgctcgagctggcacgtaccaccaagagtacttttagtcggtacgcagataatattacattcagcggtatcacgccaccggcaccagagaatattgaggccgtgatcaacgggaacgggtttcagctgcaagcgaaaggctgctatgttcagtatagaggagccaggcagtttgttacaggcctatccgtggtggaccatgagcgccctaggttgcccaagaaaatgaaaaagaaactgcggctcatagcctactacattaaaaagcacggagatggccacttcgaatttccctctcgctctcacagcatcgcgcccaccagagcgcaattcgaaggctttattgcctatgcacatagcgtcgaacctcaattcgcaaagaaattatggtcaatgctgaactga

SEQ ID NO: 14287 - RNA, 927 nt, unidentified
  source 1..927: mol_type = other RNA; note = synthetic construct
atgaccgctaccaagattgacgacattcatactctcgacgatctgagcttggtagtcggagtaaaagcgcagctgatacagcagtatgtccatgccccatgccaggctgactactaccagattatccgtatagctaagagaggaaaaggtcgaaggggcgaataccgggaggtttataaggccaaagagttttggctggcacaactccacaggtcaatcgcaatgatcattgctaattccgtgcagcacggccaacacgttcaggggtttgtgtatggccgctccacattaacaaacgcccagtaccacctactgaaaaagatcatcgtccatgcggatatcaaaaatttcttcaacgccatcacagagagtcaggtggaacaggcattcttgacgataggcgggcactcttctgtcgcgcatattttggcaagagtgagtactatcgacgggagactcctccagggtacccggtgctctcctgctgtgagtaacattgtgtgtagaaaccttgatcttcaaatgctggaggtcgccagggtaacctcgagcgtgtataccaggtatgccgacaatattactttctccggggacaagcccccctcctcaagcaatatcgaagccgtggtcaaaggctgtggctttgagctacaagggaaaggatgctatacacagcatcggggcgcccgccaatttgttaccggactgtcagtggttgatgatgaacggccacgcctgcccaagcagatgaaaaagaaacttcgtctgatcgctcactttgtgaagaagtacggtgacgagcacttcgagttttctgccgatagctcaagcatcgctcctacgcgaactcagttagagggactggtggcctacgcatactccatagaaccgcagttcgcaaagaagatttggagcatgattaactga

SEQ ID NO: 14288 - RNA, 927 nt, unidentified
  source 1..927: mol_type = other RNA; note = synthetic construct
atgaccactacaaagattaaccaaatacattccctggaagaactaggctgcgccgttggggtaccagtgtcagatataaaaacctaccttaactcgaaccggcaagtctccttttatcgaaagctccgcatcccaaagagaggcaaagctagaaaaggcgagtacagagaagtctacaaggcgtcagaggcatgggtggcccagctacacagattgatggctctgattattcggaattcagtcgagttcgggctgcatgtccagggttttgtggacggcaggtctacaataagcaacgcgcggcagcacatgaaaaaagaggttattatgcacgcagaccttaaggacttctttaataccatcacggaggtgcaggtggcagaatacttcttggccattggagcccaccccgaaatggctcccgtgttcgccaggctgtgtacaatcgatggatacttgctccaaggcacgcgatgctcccctgcggtttccaatatcgtgtgtgaccgcctggacagcgatatgctccggctggcccgttcaacaagcagtgtgtttactcgctatgctgacaatctgactttcagcggcgataatccacctagtgccaaacagatcgaaggcctggtagaggccaacggatttaagatccgaggaaccgggtgctacagccaacatcgtgggtcccgcctcttcgttactggactcagcgtggtagatcaggaaaggcctaggcttcctaagcagatgaagaagaggctgcggctgattgcatattatgtcgggaagtatggtgaggatcatttcgagcactctgagcacgcacgctctatcgccccctctttaacccagttggaaggtctgcttgcttatgcatacagtgtggagccgcagtttgctagaaaaatctgggccatgttaaactga

SEQ ID NO: 14289 - RNA, 930 nt, unidentified
  source 1..930: mol_type = other RNA; note = synthetic construct
atgaccagtgtgaagattgcggacattcaaactatagacgagctgtgtttggcaatcggtgctaatagagaggaggtgctccagtaccttcagagccctcgtcaggtggattactacgagctaatctgcattcccaagcggggcaaacgacgcaggggtgagtatcgagaggtgtataaagctaagtatcagtggatcgcacaggtccataggtcagtcgcaatgattatcaaaaacagcgcatcgtttcaagaatgcgtccagggtttcctggacgggcgttccacacttagcaacgccctccttcatatggggcaagaggttatagttcacgctgatatcaaggattttttcaatgccattaccgagttacaagtgaaggacgcctttagtgtcatgggagcttccttaattatcgctgacatcctggctaggatgtgtaccatcgatggctttctgagacagggcacgaggtgttcaccaggcattagcaatctggtatgcagacggttggacctggatatgcttggcctggccaattcaaagtcatctgtgtacagccggtacgcggacaacatcaccttctctggctgcagtcctccttcctacaacctgataaaggccgtggtggagaacaatgggttcgaactgcgcggatctggatgttacacccagtatcggggggccagacagttcgtgacaggcctctccgtggtagatgacaaaatgccccgcttgccgaaaaaaatgaagaagaaactccgcttgatagtttattatgtttctaagtacggggaagaacacttcgaagcctccgccggagcacacacaatcacacccactatgactcagctgctaggaatgattgcctacgcctatagcgtcgaaccagtatttgcaaagaaactctgggccaaactggctccatga

SEQ ID NO: 14290 - RNA, 936 nt, unidentified
  source 1..936: mol_type = other RNA; note = synthetic construct
atgacaactcgacgccttaaggatatacactctgcacatgagctcgcccaggcagtgggtgtgagcgagtccaaaattctggattatgcggtatctgactgccaggagggtttctacgagaaacttgagatacctaaacgggggcgcaacaggaaaggagaattcagagaggtctataaagctaatcacaagtgggtcactcaactgcataggtccgttagcatgttagttgctaactccgcaagctttggaacccatgtgcaggggtttttaaaaggtagaagcacattgacgaatgcggaattgcatctcaggaaaagcctgattttgcacgctgacatcagaaacttctttaatgtgattaccgaaccccaagtggctaaggccttccttactatcggggccacccccgagatttctaaactgcttgcaaggatttctacgatcgatggatttttgcgccagggaacacggtgctcacctatcatctccaacctcgtctgtaagggactggaccaggccatgctcgatctcgcatcaactcacgactgcatgtacagtcgctacgctgataatatgacaatctcgggggccgagatccccgacattagtgcgattagcacaatagtgactaataacggctttgaactccgaggctcaggctgttatatacagcggagaggcagtcggcaatttgttaccgggctaagtgtggtagatagggaacgtccaagactgccgaagaagctgaagtcgaggctaagactggccgtgtactacgccagcaagtatggcaaggaacacttcgaacggtcacgccacgtcgacaccgtcaccccatcttgggcccagatgaaaggcatgatcgcctacgctcactccatcgagcctgacttcgccgagaagctgtggaagctgctgcgtcattcccgatga

SEQ ID NO: 14291 - RNA, 936 nt, unidentified
  source 1..936: mol_type = other RNA; note = synthetic construct
atgacgaccagacgtcttaaagacatccacagtgtcgaggagctggctcaagcagtaggggtgtccgtggcaaagatattggaatatgccgtgagcggttcacaggaaggcttctacgagaagctggagattccaaaaagaggccgcaataggaaaggcgaatttcgagaggtttacaaggccagttataagtggattgcacaactccacaggtcggtgtccatgctggtgaccaactccgtctcattcgaaggacatgtgcaggggtttttgaaaggacgcagcacactgacaaacgccgagctgcatcttagaaagagcattatcttgcacgctgacatccgcaacttctttaatgtcataactgagtgtcaggtcgcaaaagctttccttactattggcgtaaagagtgaagttgcccaattattagccagggtgtgtacaattgatggctttctccggcagggtactcgctgctctccgatcatctcaaacctagtatgtaagtctctcgaccaagccatgctggatttggcttctacccacgactgcatatactcacgctacgctgacaatatgaccatctctggtgaacagatgcccgatattcgggtggttgcacagatcgtgaaggataatggcttcgaactgcgggatacaggatgctacacccagctcaggggagcgagacagtttgtgaccggacttagtgttgtcgatcgtgaaaagccacggctacctaagcagctgaagaggcggctgagactgattgtctattatgctagcaaatacgggcgagagcattttgaccggtccaggcaggtggacacgatagcccctagctggactcagatggaggggatgatcgcgtatgcccacagcatcgagcccgagttcgccaacaaactgtggaaaatcctccgaaaatccagatga

SEQ ID NO: 14292 - RNA, 1005 nt, unidentified
  source 1..1005: mol_type = other RNA; note = synthetic construct
atggcccttacgcccttttccagaatcagacacgtcggagacttagctctacacctgggctgttcacccgaggaactgttgcactttgctaatacacaacctcagcggcagttctatgacctcctgcggattcctaagcgccggggtcgggacaaagttagaatcgtctaccgtgccaatgaggagagtctggcacgaatgcataagactttagccggcgaattggcgccacaggagggagaggatttcgatgagtgcgtgcaagggttcgttagggacagatctatagttaccaacgctcgcaagcatctgggctgcaaggtgttgctgcacgccgacatacaaaacttcttcgagtccattacactcgcccaggtgatgagcgtgtttgaaaccctgggatgtaattcgggtgtggcagctctgctgggccgcctatgcactctggacgggtttctcccacagggagcacatgctagtcccgcactcgccaacagagtatgccttcatctagataccgacctgaaacaattggccgcacgacacggctgtgtgtatacccggtacgcagatgacatcgctttttccggggatgaagtcccagagcctcagagggtcgaagccattctcaataagcatgggttcaaactgagggctgagaagtgtcgcatccagcgccgtggacactctcagttcgtgacaggacttagcgtcgccgatacccagggccccaggtatagcaggcaggccaagcgatggctgcgacttgtgctgcactacgcgagcagatatgggcttgaaaaccacttaaaacgtacgggtagggggtcagcaaacccgaaactcgcctacgcggaactcgagggcatggtacgctttttgcggtctgtggagccgaggacaactgaacggatgaaccctctgctcgctgagatcggtttcagactgcacgccgacgccagggaagaagctcatgagggcgaggatgaaaatggcgagccatga

SEQ ID NO: 14293 - RNA, 987 nt, unidentified
  source 1..987: mol_type = other RNA; note = synthetic construct
atgaccggcgtagaatttccattcaagacaatccgggatgagcgggacttagcgcagcacctggaatgtgaagcgaacacactcctcttcctggccgacccaagcaggcaacatgagttttatgccgagctccgcattcctaaacgcaaaagaggcggatttagactggtgtaccgatcgcgagaggatgtcctctccagaattcataaggcactggctgttgcagtcgcagacgcagccaggttccgtccatgcgtgcaggggttcgtgaagaaacggagcattgtgactaacgctcgccagcaccttgggaagcagctgctcctccatgccgatatcgagcactttttcgaaagtatcagattgccttccgttatctcttgctttcaatctctggggtgtcgaccccaagtcgccgagcttttgggccggctgtgcacaaggaaggaagtcctacctcagggagcccatgcttcacccgtgctggcgaatattgcttgtagacacctggaccaggatttcgagcagctagctgaggtgcacgggtgtacttacacccgctacgctgatgatttgacttttagtggcgacgaagtacccgaggaaggtaatatccaaagtattctggccggctatggattcaagctgagggacggaaaatgcagaaggcagcagcggggcagaggacagttcgtgaccgggcttagcgtcggagatccggttggcccaagaatacctaagaaaatgaaacgccagctccgcagggacttacactacgccacccgatatgggttggaagaccatcttcgtcacgtgggtcggcctaccgtggatccgtgggaggaatattcagtgttagaaggccggacacgttacctggccagcgtagagcccaagatcgcctcagcaatgtggaaacaacttgttaggataagggcccagctggacaagtctgctgacacgggttccgaggaggcaccctcctga

SEQ ID NO: 14294 - RNA, 978 nt, unidentified
  source 1..978: mol_type = other RNA; note = synthetic construct
atgtggatgagtcttagaaatttcgccttcgtgagaaacattcaagatctgagtagagagttaggatgtgaacgggcccagctggaggaatatatctcttctcgccagagggaattttacaaggaaatgagaatcccgaagaaaggtcggcggcggagggaattcagaacagtttacaagccttgcagggagttggctgtgctgcaaaaaaacatcgctactctgctgcagcgcaacccactcccggagtatgtccagggcttcgtgtcagatcgatcaatctacaaaaacgcgaagattcatatcggccagaagattctgctccacgctgatatccacgaattctttgagtccattaccctagaacgggtccgtgacgcatttgagacatgcgggagcaaccgggaggtggccacattgctggccaaactgtgtaccttagacgggtttctcccacaggggagctctgcttcaccagtgctcgctaatctcgtatgtcgccaccttgacaccgacattaatgccctcgcgataagctacgggtgcaggtattcaagatacgccgacgatataactctgtctggcgatcgcgttccccctgcagagagcgtcgagaatctgcttaagaggcacgcctttgagctgcgacctggatcttgccgtacccagcgtagaggccatggacagtatgtcacgggactgtccgtggaggacgcggtacctcgaattccacgcaggatgaaacgccggctccggttggttctgaggctagcccgctcggcaatgcaacatgcagaccttttgctgtccgagacaaagatcgatggttggctggcctttttccattccgtggaacccaaccttgccagcaaattaagcgctgagtgggatcccatacgagcaagattgaataataggcacactggctcccctgatgaccccagtgaagaagtgaccgaggaagagcccagtgactga

SEQ ID NO: 14295 - RNA, 924 nt, unidentified
  source 1..924: mol_type = other RNA; note = synthetic construct
atgctgccgctacgcttctcagacctccgcagcgtgcaattggtctgcgcccacctccagacaactcctagggctctgcaaagtttcctgcgggaaccagaaagatactatacccccattgatctgccccaggctccaggtcgacgtccaaggagggtctttgaggttggggcccctctgcggagaatacatcgggtgctcgctgtggcgttagccccacacgttgacgcacagccatcctatatacagggattccgcagtggccgttcgatccgcagtaacgctgctatgcacgtagacgcggaggttgtagtgacagccgatatccgaggcttttttgacgaaattgatgtcgagcgggtgaccagcctgtttcaatccttaggcgccacttttcaggccgcaaccctgctggcaagactgacaacctttcaggggcaccttcctcagggcggacgagcatcaccggccattagcaacctcgcagtgcccgatctggataaagcattggtaagactaggtgggcgctgtgcatacacacggtatgccgacgacctgactttttcaggatctgcggctgcatgccctacggaagagcagatcagacgagtgctcgaatctagcggattccagttacgccccaggtccttccgccggcaactcaaagggagcggccagatcgtgaccgggctttctgtcgtgtctggctctcccacacttactagacggacgaggcgggagattgagcgtgccctgtacttcggcgctaggttcgggctttcctaccatgcctccagggccggtagtgaaaggagccctcagagagagttcgccagattgtgtggacacatcgctgctgccggaggcgtggataagaccctgcatgcgaagtgggttaagttgctggagtcagtcaatctctga

SEQ ID NO: 14296 - RNA, 969 nt, unidentified
  source 1..969: mol_type = other RNA; note = synthetic construct
atggagcacgttaaattcgaccagatcaggaacgatgaggatctcgcacggaatttcgggtgtaaggtcaatgacctgagaagactgacagagggtgatcagcgactgctctatcttaccattcgaattccaaagagaggggctgcgagacggggtcagtaccgcatcgtgtacaaagcgctggaccaaactttgcgcctcttgcaaaaaaatcttgctagcagtatcgcagcccgggtgaccttcgctgatcatgtccaggggtttgtggctaggcgctctattgtcacaaacgccagaaggcacctcgctcgaaagtacgtgctgaccgccgacattgagaacttcttcgaatccatcacaatagaacgagtggcggctgcattcagaggattggggtgccacgaaggagtggcgcagacactggccaccttagccaccctgaatggccacctggtgcaaggctcatccgcatcacctgtcctagctaacctcgtatgcgaaggcatggacgccgacctattagccttgggtggttcgtacgattgtacttttacgcggtatgccgacgacattactctgagcggcgatgagcgcgtaccttccggggaagagatcgccgatgtcctggcaaggcacgcctttgttctgcgggacgggagggtgagggttttacgccgtggacgtcgccagtatgtgacgggcctgagtgtatttgatgccgaaagaccaaggatcccccgcgttcacaagagacggctgaggctgctccttcattacgccagcaagcatggcttggagaaacattttgagaggataggaatcgaacccgagaaccggtatcgggaactccggagaatggagggctggatacagttcatgaggtctgtggagccccgacgcgcagctgagtttgcagcccagcttgatgacgcccgtgctgctgacgcacgtggacttccgaagtga

SEQ ID NO: 14297 - RNA, 1005 nt, unidentified
  source 1..1005: mol_type = other RNA; note = synthetic construct
atgatcgaattaaacttcaaagcgctcgaaaacatagaccatattgcccgagccgtgaattgcttcccctcttttataaacatcgtgcttgagcgcccttccctcttctatacgctgaagaagatccctaaacggggaaaaaggcaaaaaggtcagtatcgcattatttatgaggttgagtccgagctgaacattattcagaaaaacatctcaaccgctgtgaccagtaagcagcagttcccagagtatgtgcaaggctttgtcagcaagaggtctatcgctacaaatgccagtctccacctttcacagaaatatgtgctgaatctggatgtcaagaacttctttaactccattacccagaagcaggtgtcggatgtctttaaagagttggggtgcaccgagaagtcagccgaaatcttcacgaaactatgtacatttaacggacacctggtacagggcgcctccacaagtcccgtgcttgcgaatttggtgtgtaaagaactggaccaggacttcgcaggattagctcaacagtacaattgtagctactcccgatatgcagacgatatcacattttcaggcgatctgacccccagaaaaaaagacatcgagaagtgcctgaacaaatataagttcgagctgaatccagccaagtggaagcaccagaggagaggccgttctcaatacgtcactgggctaactgtttttgacaatactaagccaaggatccccaaattcataaagaagcaattgcggcagatcctctactacgccagcaagtacggttgggacaatcatcagtacaaggttaatagccataaccacaagaacatgtactatgatatcaagcggattgatgggctcatcgcatttatgtacagcgtagaacctgatagagcattcgagtttgacctgcaatggcagaaaattctgaaggaagaaggcattgtcgatgaacaggagcgggacccttacgctatattcgctcgccactctccggtgtga

SEQ ID NO: 14298 - RNA, 1023 nt, unidentified
  source 1..1023: mol_type = other RNA; note = synthetic construct
atgatccaactcgacttccagagtctcgaggacatcgataccgtggccatggttctgggctgctttcctagttttatcaacaccgttatagatacaccatcaaggttctataccctgaaaaagattcctaaaaaggggaaagggcaaaaaggccagtatagactagtgtacgaagtggatagcgagctgaatgtcattcagaagaatatcgccacggccatcgcgagtaaaattcagtttcctgaatacgttcagggctttgtgaataagcgctcaatcgcaacaaacgccgcactgcacctgtctcagaagtacgtgcttaacctggacattaaaaacttcttcgattccataaaccagaagcagatcatagaggtctttaaagagataggatgtaccgagactattgccgagatctttgctcggctttgtactttcaatggccatttagtccagggtgcttccacttctcccatcttggctaacttggtttgcaaggaactagatcagaacttcgtagagctggcaaagaagtacaactgctcttattcaagatacgcggacgacattaccttctcgggagacataacccctcgtaagaaagagattgagaaatgtctcaagaaatacggcttcgagttgaatcccgtcaaatggaaaggacaaccacgaggtaaatctcaatatgtgacgggactgactgtgttcgataatacaaagccgaggattccacgggtaatcaagaagcagctcagacaaattctgtactatgccagcaaatacgggtggtccaatcacaagtacaaggtgagcatttgcattcagaagaacatgtattatgacatcaagcagatcgatgggatgattgcttttatgtattccgtggaacccgaacaggcccttaaatttgacttacagtggcagaagatactcaaggaacaggatatcgattacgtgaagggtcgggaccccaatgtcatcttcgcaaggcgcagccaagtacagacagacatcagcgaatga

SEQ ID NO: 14299 - RNA, 1023 nt, unidentified
  source 1..1023: mol_type = other RNA; note = synthetic construct
atgattaatatcgatttcactacgattgaggagatttctcaaattgagatcgcattcgggtgtagcatcggctttatacagacagtcttagataaacctagcctcttttacgatcagctccagataccaaagaagggccgagggcagaaaggcaagtacaggatagtgtataaggtcgaagacgagctcaatctgctacagaagaacattgcaacggtgatcaatagcaaaatcagtttccccgagtatgtccagggattcgtgtcaaagcggagcattgccactaatgcctcgcttcatttgtccaaaaagtatgtgctgaacatcgacattaaagacttcttcgacacaatccatcaacagcaagtgtgtgaagtgttcaagaatctcggttgcgttgacaagattgcggacgtgtttgctcagctatgcactttcaatcagcacctggtccaaggcagttcaacatcacccgtgcttgcaaaccttgtgtgccaggaactcgatgaagccttcgtagatttggccaaacagtacaactgttcctattcacgatatgctgacgatatcacattctccggggaaaagaccccaggcaaaaaagagatcaagcgctgcctgaagaactacggatttgagctgaattctaacaagtggaaatcccaatctagagggaggagccagtatgtcaccggattgaccgtttttgacaccactatgccgagaattagtaagagcctgaaacgtatcctgcggcagatcctttactacgcctccaaatacggactggagaatcatttgaatagagtacacgactttaaccacaagaacatgaggtatgatatcaagaccatagacggtctgattgcctttatgtactccgttgagcctaacagagcattacagctggatatggagtggcagcgcatactcaacgctcaggaagccgaacaagcggagagctcttctcggaaaggcaagcgcaaccccgaagttatctttgctaggcggagtaaactgtga

SEQ ID NO: 14300 - RNA, 993 nt, unidentified
  source 1..993: mol_type = other RNA; note = synthetic construct
atgaggaggattgagttttccgaaatccgcaatatagatgatctggcgaagtgtctatcttgtacaaatgaagacctgcgccggctggcttttgacgctacctctgccaaacattgccgtaaaatgctgatcccgaagaaaaacaaaagtggccacagaattgtctataagtcctttgataagtccctctcactgattcagaagaaccttgagacaactataaaccacaacgagattttcccagagtgcgtacagggcttcgtgcgaaaagggtgtattgccaagaacgcaggtaaacacttggcaaaacggtacgttttgaatgccgacattgaagatttcttcgaatcaatcggcatgctccagattgtgaatgcctttaaaagaatcgggtgcaatgatgatatcgctataatgctgagtaggctgtgcacactcgacgagcagcttgtacagggcttcagtacctctcccgtgatttcaaacctggtgtgtcatggcatggacgaggactttgtgacccttagcaagcagtacaattgcacttatacccgctacgccgacgacatgtcatttagcggaaatgccgtgcccacccagggagacatcgaggatatcttaagcaaccacgggttcaagctcaacaaaaaaaagttctttctgcaaaagcggggagacaagcaatacgttactggcttaacagtcttcgatgacaaatatcctcgaattcccaagaggatcaagaaaaagctcagattgacgctgtattacgctgataagtacgggctactgaaccatttcgaaaagatcggaatagattggagctttgtggactgggagatcaataaaatcgacggttggattgccttcatgttctccgtcgagccagcgttggcaaagaactttaaagctaagtggaacatcatccttgatgaacacaagaaaagcatgtcgtccgaatctggtgcatataatgtttttcctgagaattga

SEQ ID NO: 14301 - RNA, 957 nt, unidentified
  source 1..957: mol_type = other RNA; note = synthetic construct
atgaagaaaataaagttctctaagatccgggatgtgaatgacctggcacgtagtttcggttgtagtaaagatgacttcaaaatcatcgagagcccaagcgaggccgtcagccactatagccgtatgttgatcccaaaaaagaacagaaagaacgctggctcataccgagtggtgtataaagttctcaaccctaaactacgcctgttgcagaaaaatatctccaccgctctggaatatgcatgctttttccccgaatacgtgcaaggatttgttaggggacgaagtattgctactaacgcaagacaccacttagcgaaaaagtgcatcctaaacctcgacatcaaggacttctttgaatccatctcccaggatcgggtaattcgggtattcgaacatattggatgcaattctgaaattgccagcatcttagcgaaagtgtgcaccataaacgggtatttgcctcaggggacatctagctccccaatcatagccaatctggtgtgtaaggatatggacgaagaacttaattctctggctatgtcctattctatcaactactcaaggtacgcagacgatatcactttttcgggtgatgcctgtccgcagagggaagagattgaggtgatactgggccgcaataattttcgcatgaacaacgagaagttcgtcatgatgaaacggggccagaatcagtacgtgacggggctgacagtctttgacgccgagagtcctcgcgtccctaggaagattaagaagcagctgagactgattctctactactcaaagaagtatggcattgaagatcatctcgagaggattttcgccgacaaggtcgggtgcccctacaaaaaggagtttgagaaaagaaagatcgagggttggattggattcctttgttcagttgagccccccctgggctataaacttaaagagcaatggctcgagatagtgaagtga

SEQ ID NO: 14302 - RNA, 1101 nt, unidentified
  source 1..1101: mol_type = other RNA; note = synthetic construct
atgaagcatactgagcttagcaccaaaaaggatctcgccaactacctgcgctgtgacctgttgttcctggagaaagccattgaggatgattacttcattcgaaatatcgataccttcaatcaggaagacgtgttgctagctagtctaaccagcctcaataacaacatcatctccgtcgatcaattcaagctccggaagaaaggccacaatggcgggtttagaacagttcataagatatggaccctgcagctcaaaaattccctgaagattctcaacaatcacctgatccaaattttcacaccacttgacattgttcacggattcgtcaaagggaagaatatacgcagtaatgctgagtgccatctggccaagaagctcgtgctgtccgtcgatattaaggactactttgagacaattacggaaaaaatggtagaagaagctctgatctcgatcggctataatgaaaacatagccctgtggatcgcaaaaatcgtgaccattgacaatcatctcgtgcaggggttctgtacatcacccactctggccaacatagtgacaaatcagctggacaaagagcttaagaaactgtgcggcaagaaaatcacctacaccaggtatgctgacgacctttacttcagctcaaatacagaagagatcccactagaatccatcaagctgactattgagaagcacaattttctgctgaacgacaagaaaactaaatttatgaagcgtggccaaaagcagtatgttactggattaacgatcttcgattcatatatccctcggatttctaaaaaacggaagaaaaacattcgcctggagatcaactacatcgagagggtgggttatagatctcatactgtacacaagctcatcaaggagggtgaagatcccgatagcttggacttttactctaagcttggagaggagatcaaattgacccgaaacagattatatgggtggttgcactttatccagagtatagaacctcagtttgccaagaagtactataaaaagctcaacgacatagaccagaagtacattttgatggcgaaacttaacgcattaaaaaagaacgcaaggaactctgatatttga

SEQ ID NO: 14303 - RNA, 1086 nt, unidentified
  source 1..1086: mol_type = other RNA; note = synthetic construct
atgaagcacacagaattatctacaaaacaagacttggcgaattatctccggtgtgatgtagcctttctagaaaaagcaatcgaggaggactatttcatccgaaatatggatacatttgacccggaggagattctgctttccagcctgaagagtaacatcagcgtttacagattcaaattgaagaagaaaggccagaatggcgggtatcgaaccgtgcacaggatttggactgcacagctcaataactcgctcaaaattttgaacgcctacttaactcagatcttccagcctctcgaaatcgttcacgggttcgtcaagggaaagaacattaaatccaacgcccagtcacacctagctaaaaagatcattctgtctgtggacattaaagattacttcgagactataaccgaggaaatggtcaagaacggtctgatgtccctgggttaccgcgaggatatcagcctgtggatcgccaaaataaccacgatcaacaaccaattagtccagggattctgcaccagcccaaccctcgcaaatattgtgacccataaactggataaagacctgaagaagctttgcgctaaggatgtgacatatacccggtacgccgacgatctgtatttcagttcagacactaaggaaattccccttgaaaacatcgcctcactgattgaaaagcactcttttgtgttgaacaacaagaagacaaagttcatgaaacgggggcagaagcagtatgtgacaggactgaccacttttgacagcaatatccccaggatctccaaacaaaggaaaaagaacattcgcttggagattaattacataaagaagttcggctacactgctcatgctaagcataggcttatcaaaagaggagaagatcctaatgggctcgacttttttaacaaagttggcgacgagatcacgctgacacgtaatagactgtatggctggcttcattttatacagtcaatcgagccacagttcaccaagaagtactacagaaagctgaatgatgtggacaaaaactctgtactaaattccagtctcaaggagatactgaaacagtttcgccaaaatatgtga

SEQ ID NO: 14304 - RNA, 1098 nt, unidentified
  source 1..1098: mol_type = other RNA; note = synthetic construct
atgaaacactctgaacttattacaaagcaggatctggccaattacctacgttgtgacctcgagtttatagagaaaattatcgaggatgactacttcatccggaacctggatagacgcaatatcgaggagctccgaagcgccctgactagcaataaaatcctggtggatcggttcaatctgcgtaaaaagggacagaacggcgggtttcgcactgtccatcgagtctggactgctaaactcaataacactctgaagatactgaatcattacctcgtcaaaatacatcaaccttcagaaatggtgcacggttttgtgaaggggaagaatatcaggtccaacgcagaatgtcacttggaaaaaaaaatcgtgctttccgttgacatcaaggactacttcgaaacaatcacggagtcaatggtcaccaattctctcaagaagctgggctttaaggataacgtagctttgtggattgctaaaatcaccacaattgagaaccaactggtacagggtttctgcacctcccctacactggccaacattgttacacattctcttgatgaggaactcaagagtctatgcggctccaatatccggtattcaagatatgccgacgatctgtacttcagctccaacactgacatattgccccttgacgacattcagctggcagttgaaaaatacggctttctgctgaacgagaagaagacaaaattcatgaaaagggggcagaagcaattcgtgaccggcttaaccatcttcgattcacacagcccacggattagtaagaataggaagaaaaacatccgcctcgaaatcaactgcattacgaagtttggatacaccgcccacgcaaagcataggcttatcgcgagaggggaggacccaaaagatctaggctttttgagtaagctgggagacgaagtgaccaatactagaaaccgcctgtatggctggttacactttattcaaagcattgagccccagttcgcgaaaaagtattataagaaactgaacgacgtgggagagaattctgtgttgagatcgacccaggctttggagattctcttacagataagggccggtcagaaggaaagctga

SEQ ID NO: 14305 - RNA, 1029 nt, unidentified
  source 1..1029: mol_type = other RNA; note = synthetic construct
atgaaacacaccgaaatcgagactagacagcagcttgcaaattacctgcgttgcaacattcattttctcgaaaaagccatcaataacgagttctttattcgcgacactaaaatcagcgaggacgtgatcccaaccattagcattccccctagtgaaataacggtcagcaagtactatataaagaaaaagggcaagaacggtggattccggattgtacaccatatctggacataccaattggagaattctctgaagatcctgaacaactatttgaacgagatcttcattccttttgattttatccatggattcgtgaaaggcaagaatatcaaaactaacgccgatactcatctggcgaaaaagataatcctatccgttgacatcgaaaactatttcgaatctatctccaaggagatgattattctcggcttatgcaaaatcgggtttaaagaggagatcgcagaatcaatagccagtatagtgaccattaatggcttcctgccccagggtttctgtacctctcccaccatcgctaatatagtgactcacgacctggatcagcagctgaagaaaatttgtggcacaaatattcagtacaccaggtatgctgatgacttatacttctccagcgatatagaaaatatcccgctcctggaaattaccaagatcatcgagatttatggattcattctgaacgagaacaaaacaaagtggatgaaaagagggcagctccaatacgtcacagggttgaccacgtttgactcgaacacatcacggatttccaaaaagaggaagaagaatatcaggcttgagatatattacctaactaagtttgggtttcggaagcacatcaagaacaaactcattaaatctggagagaatatcaacgctgaggacttcgagtacaagctgattgacgaaatcgataagacacgcaataatttgtttggttggcttcacttcattaagagtatcgaaccagaattttcagccaagtattacagcagactgaaaaaagcaaagcgatga

SEQ ID NO: 14306 - RNA, 1011 nt, unidentified
  source 1..1011: mol_type = other RNA; note = synthetic construct
atggaacacaatgagatagatactctcaaagacttggcaaattatttgagatgcgatatcgaattcctggaaagcgctgtgtcatacgaatattacgtgaaagatgccggcgtggactttaaagactccataagcaagataatcgtgagtaagttcaatatcgccaaaaaaggaaagaccggtggttttaggaccgtttatcagtgctggagccattttctctcttcatccttgaagatcctgaataccaacctgaacgagatctttatccctaaccagttctcccacggattcgtaaaagggaagaatattcagacaaacgcttcctgtcacctggggaagaagttgcttctctccgtcgacatcaagaattactttgagagtattagcaaggatcgaatttgtaaatcgctggaaaaacttgggttcaaaaagcatgtcgcggagtggatcagtaacattacaactctgaacaaccacctgcctcagggatttgctacttctcccactctagccaacattgtcacccaagagctggataatgagctctcactcctctgcggcgacttaattacatattcgcgttacgccgacgatttatacttctccacgaatttagacgagatttctctggcagaaatcacctcaattatcgagaactacgggttcaacctgaactctaaaaagaccaagttcatgtctagaggaaaaaagcagtatgttacaggtctgacggtgtttgatgtaaaatatccacgcatcagtaagaggagaaagaagaatatacggctcgagatctactacctaagcaaattcggctataagcggcacatcaggaagaagcttataaagagcggcatgaatcccaaagatccagactttaagtctcatgttagcgtggaggccgacatcacacgcgataagctgtacggctggcttcattttattaacgcaattgaacccgacttcgctaaaaaatactatccgaaactgaaaaaggccaagcaatga

SEQ ID NO: 14307 - RNA, 1038 nt, unidentified
  source 1..1038: mol_type = other RNA; note = synthetic construct
atgaagcactctgatttaagaaccataaatgacctggccaactatctgaggtgcgacgtcgctttcctggagagggccacttctaacgaattcgatgtgctcgacctagcaaatggtgataaacttaagcttagcccatccggagtcacagtaaccattgcgagaatcaaaaagaagggcaagaaaaccggctttcgaaaagtccacaagatatggaccgatgagtttaagaatagcctcaagatcctgaacaactatttacgagagatctatattcccaaagactgtgtgcaagggttcatcaagaatcgcagtatcaagactaatgccaacctccatctggggaaacgtctagtcctcagcgtggacataaagaacttcttcgaatccatcaagataaagatgatcgtttccggcctgacagaactgggattccagaagagcatagcagagtttatctcggagtttgtcactattgagggttccttggtgcaagggttctctacatcccccgttctggccaatatagtgtcaagtaaactggacttggaacttattaagttttgcggaaattccctgatttacagtaggtacgctgatgatctctacttctcgactgacgacaatgaaattgagttggacgcaattgaaaagattatcagcagccatggctttagcctgaaccatgacaaaacaaagttaatgaaacgtggacagttgcagtacgttaccgggctgacggtgttcgatagtgatagagctcgcatttctaaacagatcaaaaggaaccttagactggagatctattatatcaccaaatttggttaccggcggcacattcgcgtaaaactgaaaaaggagggctttgattcatcacttgagcacttccggctctttgtgaacgaggaaatcgaggctactatttcacggatttttggctggttgaacttcatccactctgtggaacctgacttcacagccaagtattacaagacgctgatcaagatcaaaccgaattactaccgcaaactcaactga

SEQ ID NO: 14308 - RNA, 1086 nt, unidentified
  source 1..1086: mol_type = other RNA; note = synthetic construct
atgagtagctatcccatcatcagaattaactactacctcccgtaccctaatgcccatctctatatctttgacatgaacctgttggagattaacactaagaagcagtttctctatttgctccgctgtcgagagtccttcctgaatctgattaactccagggaatacgtgatcatcgattacactaagaacgaaaacgtggatgtcgaaatttctgaaggtaccatagttatcgaacgcttctacatcgaaaaacgaaatccaaccctggggtaccggaccatctttaaaagtcttaatttcgagctggactcttgccagaagattctgaactcacttctgctcgacgtgtatacgcctctagactgtgttcaaggcttcgttcagaagaagaatatcaaaaccaatgccagcgtgcaccttgccaaaaagcagatactgcggctggacattaaggacttctttgagacaattaccaaagagcagataatcgaatccttgatcaagttaggggtgaacattcagatcagcgagtggattagcaatattgcttgcgtcgaagaacgcttagtgcaaggattcagttcttcacccattctcgctaacattgtcgccagagagatggacctggatatcctaaagaatatcgactccaccatcaattacacacggtatgcggatgacctgtatttttcaagcaatctgtctaagcccaacctcgagcttatagtcgattccgtcataaaattcggctttaaaatcaactacgcaaagacgaaggtgatgaaaaggggacagaaacagtacgtgacaggactgacagtatttgatggcctctttcctaggataccaaagaaaattaaacgggagttaagactggaagcatattacatcggcaaatatgggtacgaggagcacatcattcacaagctgaaaatcaagaaacaccagctaaaggataaggagactcaaaggcttgtggtaaatgagattgatatcaccagacatcgtatatatggctggctgcatttcataaactcaattgagccagaattctcgaagaaaatcttgactgagttgaagaagtga

SEQ ID NO: 14309 - RNA, 1029 nt, unidentified
  source 1..1029: mol_type = other RNA; note = synthetic construct
atggatttgctgcagattgaaacaaagaaggaatttctgtacttccttaggtgtagggaatcattcctggatagtgtcaatctccgggaatatgtgatcatagacaacaagaagaacaagaatgtggactttgaaattctagagaataccatcgctatagagagattctacattgaaaaacgcaatcctactctgggatacaggacaattcataactccttaaaccatgagctggaacactgtcagaaaaccctgaatactggcctgtcaaatatctacaaacccttaggatgcgtgcagggattcgtgctgaagaagaacatcaagacaaatgcctttgtccatctggctaaaaaacagatcctgacgctcgacatcaaagatttcttcgaaactatcacgcagaaacaaatcatagaatccctcactaagctgggcattaacatccaggtcagcgagtggatctcaaatatcgcctgcgttaatggctacttagttcagggcttttctacctcccccattttggcgaacatagtggccatagaaatggacctggagatatttaagaacatcgacgaaaccattaactatactcgctacgcagatgacctgtatttttcttcggattccactcaaatgtctctcgagctaatcaccaaaattatcacaaagtacgggttcgagatcaacaacagcaagaccaaactgatgaagagagggcagaaacaatatgtgacaggcttgagtgtatttgaccataactatcctcgcatcccaaaaaagattaaacgggagctccgactcgaggcatattacattggtaagtacggttacgaggagcacataatgcgaaaacttaaaatcaagaagcaccagcttaaacaccaggagattaaggggttgattatcaacgagatcgacaagacaagagatcggattttcgggtggcttcacttcattaatagcatcgagccaaattatagcaagaaaattacccaagagctcaagaagaccagtgccaatcgttga

SEQ ID NO: 14310 - RNA, 987 nt, unidentified
  source 1..987: mol_type = other RNA; note = synthetic construct
atggagaatcgggattactacatcttcgaggagtattctgaagccgtggtcagtactgccatcaatataaaacggtttcacatccctaagaagaaccctgctctaggccatagaaccattcacaagcccttcaccggaaacctggaattttgcctcaagctgctgaatagtgagattagcaagctgttcgtccccggcatcgcagtgcacgggttcgttgccaaacggaacatccgatccaatgcctattcgcatctatccaggaaatatctgcttagcgttgacatcaagaactttttcgaatccataagttcaccccaaattgtggaaagccttgtcaagataggagtgaatcgtgacattgcggaatcagtgacctctgtggtgactatcaatggcctgttggtacaagggttttcaacgagcccaacattggctaaccttgtagctaaggaatttgacgatgatattcagatgttcgtgggtgctgatattacatacacccgctacgcagatgacctgtatttttccagtgatacatctttgcctgaggttgacaagatcgaagccattttaactcagtatggattctctctcaaccattccaaaactaagtacatgcctagaggcaaggcccagtacgttacaggcctctctgtattcgacaaagcttacccaagaattccaaaaaagatcaagaggaatgtgcgactcgagatccattacatcaaaaaagacgggttcaaagtgcacatcatcaagaaacacaagattgacgaagatcaggtcccaaaggatatcctcgacgcaataattgagttcgagacgtacaacataaaacagaacttgtttggttggttacgctttatcaacagcattgaaccggcatatgcgcagaaatatctggccgagctttcagagattgagagggccaacagcctggacaaggtcgagctgaatgagatcaaccccaatataaccctgtga

SEQ ID NO: 14311 - RNA, 1080 nt, unidentified
  source 1..1080: mol_type = other RNA; note = synthetic construct
atggaaaaacataagctggtgaccttggttaccgccagcttctatatgaaggtgagtgatatcaataacctgaatctgttggctaattatctgaagctggacaaaaatctacttaagacgatttgcgagaacgactatataggcctgtccgccagagaaatactaaagtatcgcgcagataatagcgatctgacactggtcatcaagaagatcaagatctacaagaaaaacgggggcattaggacagtctacagtcccgtttccgactctgtaatcaactgcctcaaagtgctcaataaaaagctgtccaagatctatgtgccatctaaaaacgtgtttgggttcattaaggggaggagtgtgcagtccaatgcctcacagcacctgggaaaaaaatacgtgtataaggtcgatctcaaggactacttcgagtgtattaactctgacatgttggaaaaagcgttcatgcggctcggttttaataaggctgtgcttgattgcctttgtaaaatcgtaactatcaacaataccctcgcccaaggctttcacacctcaccaactttggcaaatattgtgttcatcgacttagacaatgtcttcagtaacatctcaaaaaacatcacttacaccaggtatgccgatgacctttacttctcctccgatgaagagttcgaaatacacgatttcattgtggagaatctgaaaaagtttggatttgaggtgaacgaaagcaagacccgtatgatgaaacgaggttctaaacaatatgttactggcctgacagtttttgaccctgactaccccagaatcgcaaaacggataaagaagaagattcgccaggagatttattacatcaagaagtacgggtacaagggacatgtaatgcataagctcaaggtgaaaaacaaggattacaagacaaacgaagatgtcaaaaacaaagtcgacttagctatttcagagttacagagcaaaattaacggctggctgctgtatatcaattcgatagagcctaagtttagcaaaaagtactctgagtttctctacaagaaaagcttcaaaccgattagcaacaattga

SEQ ID NO: 14312 - RNA, 1011 nt, unidentified
  source 1..1011: mol_type = other RNA; note = synthetic construct
atgaagcctactgagataaatacaaccaagcgcttagtcaactacctaaaattagacgagatgagcttcaaattgatgaccaataacgattatgtggtgatcaacgatgtggagaacgaaattgaaattcccgatgctctgaagattaggaagctcaatatctctaagaagaacggggggaagagagtcgtgtacagttgccagtcagacgtattgagcaataccctgaagattctcaattccaatctgaactccctatataaaccaccaacctctgttcacggttatgtgaaaggccgcaatatcaagactaatgccactaagcatctcacaaaaaagtacgtcctcgtactggacatcgaaaactattttgatacggtgaaaagcagtcttgttgaacagtcctttaaagaccttggattcacaacagatactgcagcgtacttaacaaaactggtgaccttccaatcagccctggttcagggctttaatacctcaccgactattgccaatatcgtgttctatcccctggacaaaaagatggagaagctggataaaaacatcacatactcccgttacgccgatgacctctactttagctccgataaggaatttaacatagaggcaaaggtccaagagatcatttcggagttcgggtttcgaataaataaacccaagtctaagctgatgaaacgaggctggcaccagtacgtgaccggattgacggtgttcgacaaagaatcacctcggatatcgaagaaaactaagaggaaactgagacaacagatttactacatcaacaagttcggctataggtcttatgttctgtatgacctcgagaagacgccccaggactacttctccagctctagtcttcgggatgaagtcgacagtaagatcgagtacctccagcgcaaacttaacggttggctgctgttcatcaacagcatcgaaccaagatttgctaagaaatatagcgacttgctgacccatcggaaaattgagccttga

SEQ ID NO: 14313 - RNA, 1035 nt, unidentified
  source 1..1035: mol_type = other RNA; note = synthetic construct
atgaaacagatcaactctagttacctgaatcactgctactttataatgagccacaagaaaattgacacggtgaagaagctgtcgaactttctcaacatcgaaaaagagatcctaagtgagttaagtaagaacgactacatcattatcgagcgcaacaattcatccactgacatcctcaataatgtccttacagttgaaaaaatcgagatccctaagaagtctggcggatttcgtgtggtgtacagccccagctctgataacctcacaaattgtcttaaggttctcaactcaaagcttagaaaaatttacgtcccatcaagctgcgtacatggatatatcaaaggaaggggcattaagaccaacgcatctgagcatttaggcaaacagtatattctgaaagtggatatagagaactacttcgagaagattaccaaagagaggattatcaagtccttgaacaatctgggctttcagaatgaaatctccagcctgatcgctaaaattactacccataacaacgttctggtgcaagggttccacacatctcctacactcgccaatataattttccacgagctggacttgatcttttctaagttcacgaatgcctcctatactcggtatgcggatgatctgtatttcagttccaaggaggagattgatattttgtcaaaagtggaagagcaattactaaagtttggtttcaccatcaacaagagcaagataaagctcatgaaaagagggcagaaacagtacgtgaccggtcttactgtcttcgacaataagaaaccgcgaatctccaagaataaaaaaaaggaaatccgccagcagatgcattacataaatcggtatgggtataaagggcatattatgcacgaatttggcatcagcaacgaagaatatttgaataacgacgagattaaggagaacgtagattacaagattcacgaactgaagacaaaaatcaaaggatggctgctgttcataaattccatcgaacccgaattctcgaagaagtacataaccctgaagtga

SEQ ID NO: 14314 - RNA, 1005 nt, unidentified
  source 1..1005: mol_type = other RNA; note = synthetic construct
atgaaattagaagagatagtcaatatccagctgttggccaatcacctgaagattgaaaaagagtcccttcagttcattgtcgataacgactacatcactgagatcaccagtaagaaggactttaagaaaggctgtctgatcaacgagatcaagatcaagaaaaggagtaatggctatcgctatgtgtacagtccggtgtctgatattctggtgaacactctcaaaatcctctcaggaaaaatcaaggagctgtataagcccacggaatacgttcatggattcgttccaggccggaacacaaagaccaatgctcaggaacacctggcaaaaagagtggtctattgcgtggacatcgataagtacttcgaaaacatcgatattgagaaggtcaaatcagctattctttccatagggtataacgaatattgttctgacaagatctctaagatcgtaacacacaaaaaccagcttgttcagggttttcacaccagccctgtgatagccaacatcgttttccacgagattgacttgaaattatcccgtctcggggacgagaatgtgagttataccagatatgcggacgatctgtatttcagcacttctggccgcatcaactttgaaaaagatatagaggacatcctcaattcatacgggtttaaagtgaatagcaagaagaccaagtttatgattaggggtcgaagccaatttgtgacaggactgacagtctttgatgaaatgtaccctagaattcccaaaaagattaaaaggagcattcggcagaaaattcacttcatatctctgttcggataccggggccatgtgctacataaacttaacatcgagaagcagctgtacgatcaaaatgaggagattcaaaagcatgtagactcgaagatatacctagagaagctgaatatcgaagggtggctcaactacattaattccatcgaacccgacttctcaaagaagtgctacagcaaattgtccaaaaaggataacccatga

SEQ ID NO: 14315 - RNA, 1026 nt, unidentified
  source 1..1026: mol_type = other RNA; note = synthetic construct
atgaatccacaaatcattacagatactaagcagttgtctaatgctcttagaattaacgaagagtcactcaatgaactgagccaaaacgaatacctcattgacgatacctgcgcaaagacattcaatctacatccagactctatcctgaatctgaagaaattctgcatcccaaaacggaataagaagttcggcgaaagggaagtgtatgagcccatagccgaaacccttaaaaacctgttaaaagtcacaaatagcgggttgaataaagtatacgtggcgcctacgagtgtccatgggtttgtaaaaggtaaaaacatcagaaccaacgcaaccccccacctggaaaagaaatacttactgtcgattgacattgagaacttctttgagagcatcaataaggagatggttatcaactgttttaaggagtatgagttcatagaatccatcgccaaagtgctcgccaatatcacaacagtggataataagctcatccagggattccatacaagtcctactatcgcaaacatgtactttaagaagatcgacctcattttcgaaactgtgtttccgaatctgacctatagtcgatatgccgacgacctgtcattcagctctaatgaggagataactgtgacccaggtcaccgacatcataaagattataaacgactttgggttctccatcaaccacgataagacgaagattatgaaacgaggacggaaccagtacgtgaccggcctgactatatttgatggaactttgccccgcgttcctaaacgcattaagcgcaagctgagacttcagatcttttacatcaacaagtatggctaccgtaaccatattctgaaaaagctaggtagaaaacctcacgagtactttaaaaactccagggttaaggagtcagtggatagctacgaggactatcttcacaacaatattgtcggctggctcatgtatattaaatccatcgaaccccagttcgctgctttacacctggagctgttgaacaatcggaggagggattga

SEQ ID NO: 14316 - RNA, 975 nt, unidentified
  source 1..975: mol_type = other RNA; note = synthetic construct
atggatctgaaattgctgaatacactcatcgataatgaatacatcatcaacgactactgtagcggcgaagtcactttaaagttcgattttaccatcttggatgttgacaggttttgtatacccaagagaaataaggagctaggacacagggtgatatacaaaccaatgagcgaatccctgaagaattgcctgaagatcctcaacattaatctcaatggtatttacagccccccgatctcagccaccggctttatcaaaggacgtggcataaaatccaatgccgaaaagcatcttaagaagaagtatatcctgtccattgacatcaacaacttcttcgagacaatcaacaaggaaatggtaattgaggttcttaaagactatgggttcatcgaggagatagcactcaaaattagcaaaatcgtcactatcaacgacaaacttgtgcagggctttcatacatctcccactcttgctaacatgatattcaagaagatcgacttgattttcgaaaagctggacgaaaatattgagtatagtaggtacgcggacgacctcaccttctcctcagattctgagattacctacctctctaagataacagaaatcattgaatcgttcgggttcgagattaacaataagaagaccaagatcatgaagagaggacagaatcagtatgtgacggggctgacggtgtttgatgaacaatatccacgaattcctaagcggattaaaaaaaagctaagactggaggtctattacattaacaaatatggactgcggaaccacactttaaaaaagatgaaagtgaactggaaggatttctttggggatgagctgataaaaaaaaaggttgagaacatggagggtttggtccacgactacatctacggctggctggtgtttatcaatggtattgagcctgtgtttagtgaaaaatgctttgagctgatgcgcacccgcaaaatcgatgtatga

SEQ ID NO: 14317 - RNA, 1089 nt, unidentified
  source 1..1089: mol_type = other RNA; note = synthetic construct
atgtatattccatccgagatcaataacgttaacaagttggccggcgtgctgaggtgtgaaatctcccagatagacaacctcgtgaacaaggtggtgcccagatccgaatttggcgaactgtttgagaaggtgcattttgatggcctgcccttccatttcgaggtgagtatgccagaggattttatactagagataaaactgcctaagcgtaaagtgcacctggggtatcgaaccgtttactctgtgttacctcacttcgccagctctgctctgaaagtgctcaagttttacttaaacgacctttatgtcccaaatgattgcgtgcatggattcattaagaaacggaatatcgtgacaaacgcacgcatgcacctgaataaaaagctcatactgaatgtcgacatcaagaacttcttcgagtcaatcaatctggatatggtcagaggggtttacgaaaagctgggtttccagaaggacattgccgaaatcctgtcaaatattacgacactaaatggacggctcgtcgcggggttcagcactagtcccgtgattgcaaacttgtactgtaatgagatggatgaagagttgatgcacgtatgctcacaaaacaatattacttacacgaggtatgctgacgatatcaccttttccggagacaaaattgacattctgagcgacgtcggagaaattctgaggcgctatgggtttgagatcaataagtcgaaaaccaggtactattacagaggtaacggtcagtatgtcacaggccttagcgtcgaggataccgttaaacctcgcgtaccgaaatacgtaaaaaaacgcttgcgtgccgagatttactccatctgtaagtacggcctcaagtctaacgttgcgcggatcttaggaatcgacgagggcggggtagacgaaactatgctcaaaaagcgagcagccaagatcattggctggctcagcttcatcagcagtatagagtacaagttcgctaaagattgctttgatcaccttcttagaatcgacaacgcccgggattcatattatatcatgaacgctctggaacatgtgagttctaagattaagaggttttga

SEQ ID NO: 14318 - RNA, 1014 nt, unidentified
  source 1..1014: mol_type = other RNA; note = synthetic construct
atgtataaaccacaggacattagctctcctctgctcttctcaggctttctgcggtgtgcagaaaaagccatccctattctcaagtccaaaagcgagggggtgttagagatgaatatcccaaaacataatcccaagtatggctacagaaaggtatacaaggctacaagtcaattgctgtcttatactttgaagcagctgcactttgaacttagcaacctgtataagccacaatcttgcattggagggtttaccaggggcaggggcattctgtataacgccagtccacacataaacaagaaagtggtactgaatatcgacatcaaagattttttcgagtccattccttttgagctcatagtgtcgaccttcgttagatatggatttacgagtgaatttgccaatgatcttgcggagatcgtgacctataataaggtgctggtggccggcttcaatacaagccccatagtcgcgaacatgtgctgtgaggacatggatgcaaagctcttggctctttgttcagcccatcagatctcctacactcgctatgcagatgatttatctttctccggggaaagcatagagtgcgtcgaggacattaaagccatcatcgttcagtacggtttcattattaacgacaagaagacccggatttacagaaaggggggtcctcagtacgtcacagggctgactgttgtggatgaaaaatgtccccggataccccgccgcattaaacgagagttaagaagtgacatctactacatcgtgaaatacggactggaatcccacattaggtataaataccaccttgacatccatatcttcgataggtattacatgggtgacctctgcctcaacgaggctcggaaaatcgtcggatggatccatttcattaattcagtcgagccgatggtggctaagcgtctgaacgaaatgctgttcaacaagcgacacgaggatctaggctactttatcaatgcctatggatacatagaaaacttgacagacctaaagtga

SEQ ID NO: 14319 - RNA, 1092 nt, unidentified
  source 1..1092: mol_type = other RNA; note = synthetic construct
atgtattcaccctcagcaatagagaacttcgaaatgttatcttcctatctgaggacaacacccgaccagctctctaaactggcccacgggcaaagactgatctttgactttaagtcggaaagtctgctagtgaacccaccagagataattatcagagaaaacgttaccgtgtttcggaagttttacatccccaagaaaaataagaagttgggctatagggtcgtgtataaagctcacaaacagttcgtgaaagacatccataagactctgaaattcaatctcaccaatatttacacccctcacacgtgtgtgcatggctttataccgggcaaaaatatccgcagtaatgcactcgtgcatcttgagaagaaacacttgcttagtctggatatcaagaactttttcgaaagcatcgataaaaagtccgtgtccgccgcgttcattagccttggcttcaacaaatctatcgcatctgacctgtctgtcatctgtacgttagaggataaactggtccagggtttccccacaagccctatcattgctaacatcgtttgcaccaaaatggacgaggaaattcagaatctgtgctgggtgtacggggccacttatagccggtatgcggatgacttgtccataagctccaattttgatatgccacctgtagaggaaatcgagcttattctgaaaagctttaacttcgagctgaacgctattaagactaagcgctttctgcgggggcagaatcagtacgttaccggactgtccatctctgactcagcctaccctaggatccccaaggccattaagaagcgcatcagacaacagctgtattacatacgaaaatacggataccactcacacatttgcaagataaagggactcgataaggagactgatctcagcataacaaagcagtacgtacgagagattgaaaacaagttgaagggttggatttcatacatccattccattgagccgttactagccgagaaatacttcgacattttcaacgaaattcagagtatcgagtatgctgaagtcatcaaactcctcaagagggacccacaaatcagacgtttcaagagcaaatga

SEQ ID NO: 14320 - RNA, 1068 nt, unidentified
  source 1..1068: mol_type = other RNA; note = synthetic construct
atgtatcagcctaaggagatcgccaacttagatctgctgagcggttatcttagaacgcacaagcacgacctaaataatttcgtgagtggcgtccgggccgtctaccagcagaagtcaggcaagatctgcgtgtacaaccacattaagtcatggaaggatattgacgtgcaatatgataagtaccacatcccgaaaaagaatcctaagttgggatacagaatcgtgtatgagattcgaacactctccgcactcaatatcttaaaggtactcaagttcaatctctcgactctttacaaaccacatgtttccgtgcatggattcgtgctgggccgtggagtattctctaatgcgaaacaacatttagctaactactatctgctgagaaccgacatcaaaaacttcttcgagtctatcaacattgatatggtgtacgaagtcttcatagacctggggtttataccagaaatagccgaggtgctgagtaaaattaccacactcgacaaccacctggttcagggtttgcctacttctcccattatagcaaaccttgttctgaagaacatggacacagaactgaaaagcctgtgtaaaaagtacaatgctgtctataccaggtatgctgatgatatctccatcagctcaaattccgacttgccccccctgaaagagatcgagaacattgtcaataagtccaagttcaaattgaacaccaagaaaacaaagacctttaaacgcggccaaaatcagtttgtgactgggctaagcatttgtgataatctctatcctcgcatcccaaagaaaataaagaggaagattcggcaggagctctactacatcaaaaagtttgggtatgaatctcacatctgcaagaagtttgactttgacgaggaaaattacaacgaagatttcgtaagtgaagagaaacggaagcttgagtataggattaaagggtgggtggattacattcatagcatcgagcccaaagttgccgagaacttttataacgatctgaaagtgattcaggacaacgaaatcaaaaagatggacgaatacggcgacgcattttga

SEQ ID NO: 14321 - RNA, 1740 nt, unidentified
  source 1..1740: mol_type = other RNA; note = synthetic construct
atgaatttgaatcagctcaacagtctcgatatcatcagcaaaagctttaacataccgctaaagttcctgcagagtattagtaagaacgagaagaacatcaagtacattgagttattcgacatcccaaagaaaaatcccaaaaggaccaagaaataccgagaggtaatcaagatcaattctccttacaatctcttctacaaagagctcctgcacatcatcgaacaagaaattgaacagaataaggccttcttcatttcgaacattgctcacggatttataaaagagcggggtgttttgaccaatgcaaaacaacatctgaacaagaaatacctgttcaagatagacatcaagaattacttcaagtccataacgaaggcaagtattaagtctgtctttctaaagctcagattttcagagaatggagccgagatctttagcgatctgtgtacattcgaagacgtgctctacgaaggcttcaatacgtctcccatcttagcgaatttatattgcctgaatctggacctggagttaaaatccctggctgatgaatataaggtaggcataagccggtattcagacgacattactttttcctccaacaacaacaactttccacccctgaaggccatccaagacatattcgacaagtacaactttaagatcaacgaggagaaaacaataagcttcaaatatggacaaccccagtatgttacaggactgagcatttcaaataacaagtatcctagggtcccaaagcgtatgaaaagaaagataagacaggaactctactacctaaataagtacccagagaattacttcaacatcgaagatggctatgcccgcctccgggctatttatggtaaaattgtgtacatcatcgggatagaaaagattctcggaaagcgttaccagagtgattttatcaacatccttgagaacaacaacatctatctcgagaatctgtacatggacgcaccccagaaaaaatctgggatgtgtacttatcattacattgacgaatctgagactccggataagaaaactctgattcttagtttggtgagcatcaatgggaactttctgaagaataccattttcaacaagctgaccttattgcagaatgacttggtttctgatctgcgcaacgggcttaccgataatcaaaaaagcaagcttttccactactgcgaggataatattaccgtgaaagagcggtatatctccattttgagagagctcaatatcgaagcccagattatgttcaaatcggaacaggaaagcatggacaaactgggtaaagaggtgtatcagaacaactattatgccctgtttaactccctgatgaaaaacattctccgaaggtacaagaataataccaacatgatcacagtcgaggaaaattcaaagatcagcctcgaaaaactgaaagaaatcgtgttgtccaaagggtcatttttccctaacactattatcgagaagtccggcaaagatgacatacttctgtcaattcctgattacattcttggcatcgtgagggactgtatggagaacaatttttccgagaagcttaacaagctaaaaacaggccagacgctgaaagagaacataaagcttaacgagatctctgataagattcgcctgattgctgacctgacaaacaatcagttctttactcagcagaataacaataagatggattgcctgaaattgaacgactatatccacaataagaccgaatga

SEQ ID NO: 14322 - RNA, 1749 nt, unidentified
  source 1..1749: mol_type = other RNA; note = synthetic construct
atgaacctctactacctaaatagcctcgacattatttccaagtcatttaacacaccacttgagtttctcaattccatctttaactccgaagtgaacagcacatacattgagctgtttaacatccccaaaaaaaaccccaagcattccaagaaatatcgggaagttatcaacatcaagtctagctacaatctcttctataaggaactcctgtgtgtgatcgaacaaatcatcggtcagaacgagaaaaactttgtcagtgatattgcccacgggttcatcaaaaaccgtggcgtgtttaccaatgcgaaacaacatctaaataagaagtacctgttcaagatcgacataaaagactttttcaagagcattccccaagatgggatatccaacactttccttaaactgggctgttcacaggatggcgccaacctgctgagcacgttatcaactttcaatggcattctctacgagggatttaatacttcccccatcttagcaaacctgtattgctacaatttggacctggaactcattaaacttgccgatagttatgacgtcattgtgacacggtattcagatgacattacattctccagtgacacaaattcttttccttcgattgatgaaatcgagaaaatcctgaaacagtacttcttcaacataaaccatgagaaaaccctctacctcaaatatggtcagccacaatatgtaacggggctgtccatctctaatgataagtaccccagggtcccaaagcgtctgaagaagaaaataaggcagaatctgtattacatgaacaaatatccagagaactacttctataaggaagacaattatgctgtgctgagagctatctacggtcatatcgtatatctgctcggaattgaaaaatcgttagggaagaagtatcagagcgagttcatcaatatcatcgaaaactacctcaacctggaagacatctatatcaactctcctcagaagaagagcaccttgagtacttaccactatattgacgaatcagagttcatagattctaaaaccaacaagtactaccttattcttagtctgatttccataaacggcgagtttcaaaagaacatgatcagcgacaagattaatgctctgaagaatgatctggcctctgattttagaaatgggttgaacgacgaacagcgctcaaagctgtttcactactgtgaggataacatcagcgtgaaggaaaagtacattagcatcctgcgcgaattgaacattgaggcacacatcattttcaagtacgaagataaaccgatgaaaaagcaggactatcaggataattattacgccctcttcaatagtctcatgaagaatatactacggaggtacaagaacaatacaaatgtcatagtggttgaggagaatagtaaaatctccattaacaccttggagaaatcgatactgaatagacgattcttctttcctaatatcgagattgccaaagcttctaaagacgacgttcttctgtccatccctgattacatcctgggaattgtgagagactgcctgaaaaaggacttcttggagactttagagaaattaaaggcgggccagcgcctaaaggaggatataaagtttgacgagatcagcaacaagatacggctgatcgcaaaccttaacaactctaatttctttaccaggcagaataatagccagcttacctgcatcaagttgaatcagtatattcaccacaaacgaattttgggatcttga

SEQ ID NO: 14323 - RNA, 1719 nt, unidentified
  source 1..1719: mol_type = other RNA; note = synthetic construct
atggatatcaggaaactgaattcgctggaggctattgctaagtcttttaataccgacattggatttctggaattcatgaaagagcctgaaaataccaagacgcagagcgactactttaaactacttaagctgaagaagaagaacaaaaagttctcaactagtttccgggaagtgcttaagatcaacgagcctttcaatgtgttttacaaggaactgctcaatgaactggagaagatcatctactcagactacaacaagtatatttctgaatacgctcatggatttcttcgcggcaaaaatatagtttcgaacagcaaagagcatcttaacaagtactatctctgtaaattcgacatcgaggattttttcgtgtccattaagaaggagagtatagagaaggtcttcataaaaattggctgcgagaaacaagccgccgaactatttagtaatctgtgcacttacgataatgctctcaaagaaggtttaaatacctcaccactgctggccaacttgttttgtcataaactcgatgctgatatccggagtagtatcgccaaaaacatcgtgtatacacggtatggcgatgacataaccttctcttctgacaaaaacaatttcatcaagacagacgatctgcaaaagatactgaataagtacaacctgaaactcaataagcaaaaaacactgtttgcaaaacagggacagccacagtatgttaccggtttaagcattagcaacagagagtatccgcgcgtccccaagaaattaaagcgaaaggtgcgacaaaaactctactacatgaacaagttctttgaaagcaattccgaagaggagctgctgaagagactctatggggagattgcctatattatagggatcgaaaaggacttgggcgagaaatacaaaaaaacgttccttgagatccttaaaaacaacaactgtacaattgacaacgcatctgcgaaaacttttaaggtcacaacggcaaaaaggattttccactacatagatgagtcagagatcatcattagcactgatgctgataagcagtatttagccatttgcgtggtgtccattatctccgactccgataaacagaaaaatattcagaagttgggggagctgaaaaacagctttttgatcgacgcaagggacgaatttataaaaaaagagggcctctttcactacactagtgataatcccgaagttaagatcaaggtccaggatctgcttagagaactagaatatgaggcgtttatcatcttcggcaaattcaataagaagattaccaaggaggaatatcaggagttgtattatgggctattctcaaagattttcaacaatatcctgctcaatagattcggtgatgccaataattacatttgctacgaagaaaactccaagatctctactaataagctgagctcctatttgtgcaacaaaaagcactctaccaagttcaagattgagaagatatccaaaaaggacattttgtccaccctgcccgactatgtactgggaacattttgtagcttagcaaaggaggagaagctccttgagaagatcgaaaatcagaagtacccttttgccctccgtaacctgaacaaaatcagctcaaagatccgcctgatcgtagacaacaacaacaaaatctactactctaggcagaacaaaaataaaaacgacttcctcgagattaacaagaacatcatgaattga

SEQ ID NO: 14324 - RNA, 912 nt, unidentified
  source 1..912: mol_type = other RNA; note = synthetic construct
atggaatccctcaatttcaataagattcgcaacattgacgatctggccctgtactttcaatgtacaattgacacgctgaagaacatcatagagaacaaagagaactatagctctagaagacaaattccaaagaaaaatggcggaaagagaaggattatcatcatcaacaactttgattggtcacggtttttgaaacagattcacttttccatcgagaaacagtatccttacctcgactgtattgaaggattcttaaagagtaagagcatcaagactaatgcttctaagcacatcaataaccagtatttgttaactctcgacataaaggacttctacttttccattaagtacgaggatattatcaactcattcaaggcacttggggctaatgataccgtgtcagagatacttggtcaaatctgcacctacaataatctgctctaccccggctttaacacctcccccctaatctcaaacatcgccttcgagagtttggaccgcaaaatctgcgacctctgcaaagagaaagggataaactattctcgatacgccgatgatctgtccttcagcagcaccaatccaattgagatcttgccgataattaaacagtatctgtctgagaaagcgtttgaaatcaacgaatacaaactgcggttctctaagcatggccaggcacagtatgtcactggtctaagcattagcgataagacaatgccacgtcttcctaggaaatttaagcggaatatcaggctcctgctgcactacgctaaaatgaatgggattgaaaactaccacaaacatcccaagagtcgacacctgctgacaatatacggacagatcatgtatagttattcgattgaacctcatttcgccttcaaatgtcttaagatcttcaatgacatcaagaagtga

SEQ ID NO: 14325 - RNA, 909 nt, unidentified
  source 1..909: mol_type = other RNA; note = synthetic construct
atgcttcttctggactttcccaatatccgccacaaaggtgacttgataaagtacttccagacaaacacggaaacattcgattcagtcctggtttccaaaaataaatttgcccacgtgattaacatccccaagaagaagggaggcaatagagaggttatcaagctcaccaacgaagattggaagaggtttttgaaacagattaacttcagcctgcaccagctatacacctttcctaactgcgtccagggcttcattccaggacgaggtataaaatctaactcttacttccacctcaagaatcggcagctccttgtgtgtgacatcaaggacttttactatagcattaaggaatccgacataagcaacatctttaagtacttcaaggcttcagatgaaatcgcaaacttactcgccaaactttgcacgttcgagggcattttattccccgggttgaatacctcccctactctggcgaatctgtattgtgagaagatggacgagaaactgagcatactaatgactagccatcaaggggtctacacaaggtatgccgatgatcttactttttcgagtaaccagaccctccccaacctgaaagacatctctgagctcctggaaaattataactttaagttgcaggagcgtaagacccgatatagttccccaggccaacggcaatatgtgacagggctgtcaatcagtgataagagggtgccaagactgccgaggaatttcaaaagaaacatcagactgctagtacatctcgcagaaaaattgggcgtgaaagagtaccacgagaatttaaattctcgcaacctgttcactctcaagggacagctggtatttgctatgcatattgagcctattttcgccaaaaagtacctggtgcgcctgaatcggctgatctga

SEQ ID NO: 14326 - RNA, 939 nt, unidentified
  source 1..939: mol_type = other RNA; note = synthetic construct
atgatcaagttagatttctctaagttccaagacgagacaacgatctctactaacttccacatcctaaaaaagaatctggacgatctcctgaccggcaaccaggaggacttttacgaagtgttacatatcccaaaggctaataaaagtctgggataccggaaggtgtataaacccaattggaagattgacggcttgcacaaatacattctggagcagatcaattttaagagcaaacctcttattcacgattgtgctcatgggttcataaaggggaaatctatcctcacaaacgcacagcagcacctcaataaaaaatacctgctgcaggtcgacattaagagcttctttagctcaatctcccaggatgaggttaagcgggtgtttattaagctgggctgcaacgattatgtagcggagctgttcagtatcctttgtaccatcaataacagcctggccgaaggactgaatacatcgccgactattgctaacatctacttcttcgaactcgacgaaattctgaatgaaatctcccgacgctatagttgcacctacacaagatatgccgacgaccttacttttagctcaaacaactatttcgactatacggagttgctcaaagagatcgaggatgccctggaaaagaagaatctgacccttaacaacaagaaaactaggttctccaagtatggtcaggcacaatatgtgaccggcttgtcaatatccaatgaggtcagacctcgcatacccaagaaaataaagaaaagactacggcaagagttttactttattaagaagtacggcttcaacgcacacttttctaggtgcaaccagaacattaaaaatgggcataataggctgaacggatggttactctacgccctcaatgttgaaccagattattttcgtaagctttacgccgaatacaaaggtttgaaatga

SEQ ID NO: 14327 - RNA, 1668 nt, unidentified
  source 1..1668: mol_type = other RNA; note = synthetic construct
atgaaccaggtcgtggatttctcgggcctgagcaacttgcggtccatagcctcaacctttaataccaagctggagtttctcgaatccatcctgaagtcccccacccgctctgagttctaccaaaaaatgttcatcctaaagaagaacggaaagggctaccgattagtgtacaaagccatcaataaatcactgtctctctttcacaaaaaccttagcacaagtctccagaagctggaaaaagagtttgtacatgattgcgcatatgggtttgtgaaagggaaatcaacatttgacaatgccaagattcatctgaatcggcaaatattggttcagttcgacattgaaaactttttcaagtccatcaactacgagaatatcaagaagattttcttccaactgtgcaagaacgatgatatcgcttccatcctgacatctctgactacagtaaatactagcttggttgagggacttcacaccagcccagtgctggcaaaccttttcttctatgacctggacatacaattattcgaacttgcgcagaaacacgactgcctctatacccgttatgccgacgacatcacattctccactaacttcaaggatatcaacgttaagaagttagaaaaggaagtgtcggccatcctcaaagagtccaatctgagtctgaataacgagaaaactcgcatctctaagaaagggcagcctcagtacgtgacgggcctcagcgtcagtaaccctgaatttccccgaatcccgagactgatgaagaagaaaattcggcaggaactctactatattaagaagtatggtgcagaggatcatttcatgaacaagaaggagaaactgtatgatggcatgcagaggctgaacggatggatcatttattgtcatgcgattgagaaagagctcgctaagaagtttcaagatcagatattgatgacggacgcttatactgacattcatgagtacaataagagactaaggaagaaagagaaaagaaaagaagagctgcacctgtactttgatgaaactctctacgaaaattacttcggcatgtcatgcgtgttgatccaggacgagaatcaccaggatattagcaatgaccttaacaccttttacgaccaattgtcaggtgatcagctgataccaaagaaaggtaggattttccattactgtgaggacagtcacgatgtcaggggacaaattgtggaccgcctgaggaagtgtgattttcaggcctacatcgtgttttctaaactggaaaccaatagctacacaaaagatgactacctgaagatcttctataaggtcttattcgatcggatccacaaaaattatgattgcactgtgcacatttactacgaggagaataacaagatcaaaaccgctgatattgatgacctagtcgaagacatcaaagataagcttaataaccagacaagtatggtgatatctataaacatccagaagattaccaagcagaatcatctcagcgtgattcccgactatgttcttgggttgtttaaagacgcctacctcaaaaaagagagaaaggactttgaaattcgctattgtcagaaactatccaacaagataagactcgtaatcgacctggacacgaataaatattattcacgtcaccagacccttagcttatctaacgagtga

SEQ ID NO: 14328 - RNA, 984 nt, unidentified
  source 1..984: mol_type = other RNA; note = synthetic construct
atgttgattaagttctctgagatcgagaacctgactatgctcagccaatttctgtacatcaaagaagacaacctactgacactgttgaaggaaggcgctgttagcagctgttgcgaaaagatggccatacctaagaaaaaccgggccttagggtatcgggtagtgtataaagttaactctcacctcctgaaaaatgtgcataaggtcctgtgcggtcatcttaatgccgtctatgatgcccctgcgtttgtgcacgggtttgtgcttggcggatgtacaagaagaaatgctgcacagcatctgaataaaaaaaagatcctgggcttagacatcgatagattcttcgacagtattagtgagaacgcgattaaggaagtgttttgcggcctggggtgtaggatgaatatcgcagccaatctgtcaaagctaacaaccatcaatggtcgacttccacagggtttcaatacgagccccgtattggctaacataatgtttggacacctagatgcccaactgaactctatttgtaacgactatgggtgcatatatacacgctacgctgacgacattactatttccaccgatgaccagcttcctccagtcgctcgcatcaacgacgtgcttttcactggcggcttccgcttaaattcatccaaggaaagggtaatgtttagaggcaaaaaacagtacgtgaccggactgaccgtgttcgatccagagtatcccagggttccgaagcgttttaagcggcggattcgactccagttgtactatctggtgaaattcggagcaaagtcctacgtgatgcgtgaactcggtctgtccgaggaagatgtccgcaacgattatgagaaactgcaactcgtctcgggaaggaaggtgcagctccagtaccagatcaaagggtggatagactacgttaattctatcgagcccctcttgtcagagaagtactacgagagttacaacgcaatcgcctggtga

SEQ ID NO: 14329 - RNA, 972 nt, unidentified
  source 1..972: mol_type = other RNA; note = synthetic construct
atgagtttctccgtggatcaactagctgagcaagtgggaacttccgtggagaacctcgaatttctgagcgagcatctgccagcaggggaaggactgctgtacgtgcagcggcggcacaggaaaaagcatggaggcatacgtgaagtgttcgagcccaaacccccttttaatgccgtctccaaaaaccttcacagaagctttaccagccagtttagttacgaggccccagaccacgtgcacggatttgtccgcggtcgatccaccatttctaacgcgagtcagcatctggctaagaagtgcgttttgagaatggaccttgaagacttctttcctagtatcggcgcagcaacgattagggctagcctaagagagcagggcttcgacgagaaagccgccgaactggctgttagcctcgtaaccatcggcggcaagctgccgattgggctctctactagccccttgctcagcaacctggcctttttggatacggatcgatcactggccgcctatgccaggtcagagggcttatcattcacacggtatgtggacgacctcacattctctggggacgttactgataggcactcgaccgacatcgcacgaattctggacgatgctggatggtctgtcaatactcggaagacagccttcatgaggagaggggggccacagtatgttaccggcctttacgtcggcgagtcagatgggccccatatccctcgcgcgttaaagagaaaaatgcggtggatcctgcatgtcatatccaagttcggatacgaagcgtacatgacagattttggtggtgagaatgaaggcatgtatcgctgtaggcttctgggttgggcatgctatatcgctgccgtggaacgtgacgtggggttctccctccttcgcgagttcgatcgcttagtacctgagggatctgatgaggaattgcacggctacgacgaagacctgtacgatctcctgtga

SEQ ID NO: 14330 - RNA, 963 nt, unidentified
  source 1..963: mol_type = other RNA; note = synthetic construct
atggcattctccgtcgaccacctcgccgaacaggctttcctttcagtgaaagatctcgagtggcttagcgctcatcttccggctggggaaggcactttttacgttcagaggcgccaccgcaagaaacatggaggtattagagaagtctttgaactgaaaccacctttcgacaccgtctccaagaatttgcacagaagcttcacctcgcgtttctcttacgaggcaccagcacatgtacatgggtttgttcgcgggcggtctaccatctcaaacgccagtcagcacctagccaagaggtgcgtgttacgtatggatctggaggacttcttcccaagcataggggccgcggcaatccacgatttgctcagggagcagggatatgaggagaaagccgcagaactggccgttaatctggtgactattggcggaaagctacccattgggctgtcaacatctccactgttatcaaacctcgcttttctgtccacggatcggagcttagccgagtatgcccgctccgaaggactcagctttacacgctacgtggatgacctgacttttagtggcgacgtcaccgataggcatagcatggacatcgctaggattctggatgacgcggggtggtccgtgaacacacggaaaacagtgttcatgcggagaggcggcccccaatatgtgaccggactgtacgtgggcgagagtagtggtccccgaatcccccgaaaggtgaaaagaaagatgaggtggatactccacgtaatctctaagtttggatacgctgcctacatgacggactttggcggtgaaggcgatgagatgttccgaagacggctgcttggttgggcgtgttatattgcagccgtcgagcctgacgtgggataccctttgctgagagctttcgacgaattggttgatgaagaagatctggagggggacgaggagggcctctatgacctgccttga

SEQ ID NO: 14331 - RNA, 924 nt, unidentified
  source 1..924: mol_type = other RNA; note = synthetic construct
atgccatatagcgtacacgatctggcacagcaggcaggcgtgagcgtggaagtgctcgagagactgtcgtccatgttaccggcaggagccggccaactctatgtccagcggatctaccgtaaaaagcacggcggaattagggaaattttcaagcctaagcccccttttgatgccatcggcaaaaatttgcatcgaagtttcacctccctgttctcatacgaggctccagatcacgtgcacggttttgttagggggcggtctactatatcaaacgcaagccagcatctggctaaagggtgcgtcctacgcatggatctggaggacttcttcccatctatcgacgccgctaccatcaaggcttctttacaggagagaggatatgaagagaaggccgctgactttgccgtgaacctcgtaacaatcgggggaaaactcccaattgggttgagcacatcccccctgctgagcaatctgatctttctgagtaccgaccggagcctagctgaatacgcgcagagtgagggactttccttcacacgctacgtggatgaccttgcgttcagtggagacgtgaccgatcgccactctgcagacattgcccgcatacttgatgacgccggctggtcagtgaacacacggaaaaccgcatttatgagaaggggcgggccccaatatgttactggactttacgtcggtgagtccgatggtccgcggattccccgaaaggtcaaaagaaagatgcgttggattctgcatgccatctcaaagttcggttacgaaacgtatatgactgagtttgggggcgaggacgagggcatgagaaggaggcgcttgctcggctgggcttgctacatagccgaagtggaacccgacgtcggctatcctctgttgcgaggttgtgttgggtggccttgggccgggtga

SEQ ID NO: 14332 - RNA, 1011 nt, unidentified
  source 1..1011: mol_type = other RNA; note = synthetic construct
atgatcgcgctgacctgggaatgtgatcctatatccaggaggcctgcagcagaagggccagtggagttcagcgtcaataacctcgcggagcaagcgggcgtctctgttcggaacctggagtggctgtgctccaatctgcccacaggagccggaaggctgtacgtaagaagaacgaaccgcaagaagcatggtggtgtccgcgaggtgtttgagcctcagtttccattcgatgtcgtgtccaaaaatttaaaccggagttttacttcactcttctcatacgaagccccttctcacgtgcacggcttcgtgagagaacggtctacaattagtaatgctagccagcaccttgccaaaaaatgtgttctccggatggacctcgaggatttctttcctagcattgacgcagccacacttaaagcctccctcagggggcagggctacgaagagaaggctgccgagttcgctgtgaagcttgtgaccataggcggtaaactcccagtgggactgagtacttcccccttattgagtaacctagtgttcttggggaccgacagaagccttgctgaatacgcccagtcagaaagcctgtcgtttacgagatatgtggatgatctgattttctctggcgacgttaccgaccgccattccgccgatatcgctcgaatcctggacgacgctggatggagcgtcaatacccggaagacagtatttatgaggcgaggcgggccgcagtatgtgactggactgtatgtcggcgagtcagacgggccgcgtatacccagaaaggttaaacggaagatgcgctggattttacacgttatctctgaatttgggtacgacgtgtatatggaagaattcggcggagaggatgagggaatgcatcgtcgccgactcctggggtgggcatgctacatcgctgccgtcgagcccggtgtaggctttccactgttgcaagcattcgatgaactggtgcccgagagggccgaggaggatctatatgacttgccatga

SEQ ID NO: 14333 - RNA, 939 nt, unidentified
  source 1..939: mol_type = other RNA; note = synthetic construct
atggtggatgatctggccgagcaggccggcgtgtctgttgagatcctagaagccctctctagcgcactccccgctggtgcagggaggttgtacgaccagcgaatatacagaaaaaaacatggagggatccgagaggttttcaatcctcggcagccactggctacaatatccaaaaaccttcaccggtctttccttcatctatttagttatgatccaccaaaccacgtccacggtttcgtgaggggccgctcaactgtcagcaatgccgggcaacacctggcaaagccctgcgttttgagaatggacttagaagacttcttcccgagtattggcgcggctaccatcaaggcgacccttggcgaacagggatacgaagagaaggccgcagatattgcagtaaatctggtaaccatcggaggaaaactgccgattggcttaagcacttcccctttgctgtcaaacctggcatttctgtccaccgacaggtctttagccgagtatgcccagagtgaaggtctgagctttacgcggtacgtggacgatctcacattttcgggggatgtgacggaccggcatagcgtggacattgcgcagatcctcgacgatgctggctggtccgtgaacactcgtaagacagccttcatgcgcagaggagggccccaatatgtcaccgggctgtatgtaggagagtcaggcggccctcgtatacccaggcaggtgaagcgcaaaatgagatggattctccacgttatttccaagtttggctactacacatacatgtcagagttcggaggcgctaatgaagtcatgctgcgccggagattgctcgggtgggcttgttacatcgccgctgtggagcctgatgtgggttatcccctcctgagggcctttgacgagctggtcccagaacctgatgaggacatctatgacctgctttga

SEQ ID NO: 14334 - RNA, 960 nt, unidentified
  source 1..960: mol_type = other RNA; note = synthetic construct
atgccttactccatcgacaatttagcagaacaggctggagtatcggttgaactgctagagcatctcagtagctcccttcctgccggggctggacgtctgtatgtgcaaagggttcatagaaaaaggcacggcggagtgcgcgaaatcttcaagccgcgaatggactttcagttcgtaaacaagaacctccatcggagcttcatcggcctgcttccgtacgaagctccagatcacgtccacgggtttgttcgagaacgctctgccgtctcaaatgctaggcagcacctcgccaaagcatgtgtgttaagaatggatctggaggacttctttccaagcattcgggctgagacagtcaaggtaagcctgatggagcaaggctacgaagacaaagccgctggagtggccgtcaacttagtgacaatcgggggcaagctgcccatcggcttgtctacttcccccttcctcagtaatctggcgtttctcgacactgaccggtccctggcagagtacgctaagtcagaggggttgtcttttacccgctatgtggatgatctggcattttctggtgatgtcacagatcggcatgccgttgacgtggcccggatactagatgacgccggctggagtgtcaacacgcggaaaactgcgtttatgagaaggggtgggccccagtacgtcaccggtctgtatgtgggtgagagcgatggaccccgaattccaagaagagtgaaacgtaagatgcgctgggtgctgcacgtgatttccaagttcggatatgatgcatatatgatggagttcggcggctcaggggagggaatgacaaggcgcagactcatgggctgggcctgctacattgcggccgtggaacctgaggtggggttccctctgctgagggagttggatgcacttgttccagacgaggacgaagaggaccttgactacttggaaataaccacctga

SEQ ID NO: 14335 - RNA, 951 nt, unidentified
  source 1..951: mol_type = other RNA; note = synthetic construct
atgccatatagtgtcgaagatctggcacagcaggccgacgtttctacagagatcctggagtggttgtcctcagaaattccgacagggtttggcagactttacgagcaacgtatataccgaaagcggcacggaggtgtgagggaggtcttcaagcccaaacgccccttcgataccgtgtctaaaaatctatatcggagtttcacgaggctgttttcttatacggcccccgaccatgttcacgggtttgtgcgcgagcgatccactattactaacgcgtcccaacatttggcaaaaaagtgtgttctgaggatggacttagaggatttcttcccttctatcggagccgctactgttcagacaattctgagagaacagggttacgagggcaaagtagccgatctcaccacctcactcgtgaccattgggggcaagctccctatcggcctgtcaaccagcccactcatgagcaacctagccttcctgacaactgatcatagcctggccgaatacgcgcagtccgaaggcttgagcttcacacggtatgtcgacgacctcactttttcgggtgacgtgacagaccgccacgctacagatatagctcgtatcctggatgaagccggatggagtgtgaatacgagaaaaaccgtgtttatgcggcggggaggtccacagtacgtaaccgggctttatgtgggcgaatccgacggaccaagaatccctcggaagctcaagaggaagatgaggtggatccttcacgtgatctcaaccttcggatacgatacttatatggcagagttcggcggccgcgaagaggggatgcgaagaagaaggttgcttggctgggcttgctacattgccgcagtcgaacccgacgtcgggtttcctttactgcgcaaatttgacgagctggtgagcgagggggatgctgaatactgggacgaggagtattga

SEQ ID NO: 14336 - RNA, 963 nt, unidentified
  source 1..963: mol_type = other RNA; note = synthetic construct
atgccttacagcgtagatgacctggccgagcaggcgggagtatcagtggagatgcttgaaaggctttccagtactctccccgcgggtgcaggtcgactgtacttccagagaagatttcggaagaaacatggcggtgttcgcgaggtttttaaacctatgagtccctttgatgccgtcagcaagaacctccacaggtcattcacagggttattttcttacaaggcacccgaccacgtgcatggctttgtgcggggcagaagtgtcatctccaatgccagccagcacctggctaaagggtgcgtgttgcggatggacctggaagacttctttccatccattggcgccgcggcagtgaagtcggccttatgcgaggaggggtatgaggagaaggccgctgacctggctgtcaacctggtcaccattggaggcaagctgcctatcggactctccacttcaccattgcttagcaatttagctttcctggccacagatagatctctggccgagtacgctaggtccgaggggctctcattcactcgctatgtggacgacctcacgttcagcggtgacgatgttaccgatcaccatgcagttaatatagcccggatccttgatgatgctgggtggtctgtgaatacaagaaaaaccgctttcatgaggagagggggtccacagtatgtgaccggcttgtatgttggcgaaagcgacggccctcggattccgcgaaacctgaaacgcaagatgaggtggatcctgcacgtagtctctaactttggctatgatgtgtacatggcagaattcggagggcgtcgagaaggaatgcgtcgccgcaggcttctaggatgggcctgttacatagctgccgtggagccggacgtcggatacccattgctgcgggcattcgacgaactggtgcccgaggatgaagaggaggaagaagaagggctatatggcctccaatga

SEQ ID NO: 14337 - RNA, 954 nt, unidentified
  source 1..954: mol_type = other RNA; note = synthetic construct
atgcctttttccgtagacgacctggcagagcatgctggcgtctctgccgaggccttacagaaactatcctccagcctgccaactggtgctggacgcctttatttccagagaacgttccggaaaaagcatggaggcatcagggaggtgatcaaaccggcatcaccatttgatgcgatctccaagaatctcaataggtcattcaccaccctgcttccttacaaggcccccgagcacgtgcacggattcgttcgcggccggagtgtcgtatctaatgctagtcagcacctggccaaagagtgtgtgctccggatggaccttgaagacttcttcccaagtattagcgcgaccacagtcaaggcactgctccaggaccaaggctacgaggaaaaggcagccgatattgctgtgagcttagtgaccatcggaggccggttgcctataggcctgtcgactagtccctttctatctaaccttgcattcttaagcacagatcgatccttgagcgactacgctagaagcgaggacctcagctttacgcgctatgtggatgatctgactttttcgggtgagataaccgatagacattctgaaaacattggaagaatcctcgatgacactgggtggtccgtcaacacacgtaaaaccgccttcatgaggaggggggggccgcaatatgttactggtctgtacgtcggcgaatcaggacggccacgtataccccgaaaaatcaagcgaagaatgcgctggattctgcacatgatctcaaagtttggctacgatacatacatgtctgactttggtggggaaaacgaagaaatgtatcgcaataggctgatggggtgggcctgctacattgccgcggttgagcccgacctgggctatcctctcctgagggccttcgacgagttggtgcccgaagggtattacgagacagctgtgtgggatttgggatga

SEQ ID NO: 14338 - RNA, 993 nt, unidentified
  source 1..993: mol_type = other RNA; note = synthetic construct
atgcctttcagtgtggaagatttggctcagcatgctggggtatccgcggaggtcttagaagtcctctcctcagcactacctctcggcgaaggaccactttaccgggcctggacatccagaaagaagcacggtggcatacgcgaggtcttcaaacccctgtcacccttcgacgcaataacaaaaaacctacataggtctttcacggatctgttaccttacaaggctcctgaccacgtacacggctttgtgaggggccgtagtactattaccaacgccagccagcatttagggaaggcatgcgtgctgcgagtagatctggaggacttctatcccagcatccgagccgcaatggtcaaggcctcacttcaagctcagggctacggtgagaaagccgccgatgtggcggtgggaatcgtgacaattgcaggcaagctgccagtggggatctctacctctccctttctcagcaacctggttttttgggacacggaccggtccttggcagaatacgcccagcgggagggactcagctttacacggtacgtggacgacttgaccttctctggcatggtcgtggatcgccaccttgcagagatcactagaattctggacgatgctgggtggtcggtgaacacccggaagactgcctttatgaggagaggtggcccccagtatgtgaccggattgtacgtcggcgaagctgacggacctaggatcccgcgcaaagccaaacgtagaatgcgctggatcctgcacaagattagcaaatttggctacgagacttatatggaagattttggtggagaggaccaagttatgtatcgaaataggctgcttgggtgggcttgttatattgctgccgttgagccagatctggggttcgacctgctcagaaagttcgatgatctgattccggaaggttattacagtaatggatatgccgacatggcggggctcctgcatgttataaatgatatcgacgatctcccatga

SEQ ID NO: 14339 - RNA, 1029 nt, unidentified
  source 1..1029: mol_type = other RNA; note = synthetic construct
atgactctcgtgttgaccgccgacattctcatcggtgccatagggtacccaacgagggtgctggaagaactcgcactgatgttgagaggcggcggactgcaggtctttagcctgcaaagtcaccggaagagacgtgggggtgtgagggagatcgttaagccccggccacttctggattctgtgtcgaaaaacctttacagaagcctcctagagctgctgccctacaggcccccagaccatgtgcatggcttcgtccgcggcagaagcaccctaaccaatgcccgcgcccacctcggcaaaccatgcgttctgagagttgatcttgaggacttttttccttcaattagttctacaaccctgcagggagctctggaccagcagggctgtgatgagaaggcggccgaattagtggtatccctcgccacggttttccagcggctgcctatcggtctgtctacatcacctttcctgtctaacgtcgtctttctgagcacagattatgctttatccgaatacgcccgcgctaacaatttgtccttcacacggtatgtcgacgacctcgcattttccggagacgtgaatgaccagcacttcgaagctatcagtgagattctgaacaacagtgggtggtcaatcaatgtcgataaaaccgcttttatgaggcggggcggtaggcagtacgtgactgggttgtatgtgggaatggcggatcgtcccagagtaccgagatctttacgacgcgagatgcggcgaactttccatcttatcgaaaagtttggatacgaatgctatatggaggacttcgggggagaggccgcagcgatgttccctcaacgcctacgtggctgggcccgatatattgcaagcatcgaaccggacctggggtatccattgttgaggcgcattgatgagcttgtacccgatcaatatgtgtccgctagggacctggaggcctactacgattacggcgagtaccaggtgatagagagcgcagaagatctctatggatcagaggggcctgactactga

SEQ ID NO: 14340 - RNA, 960 nt, unidentified
  source 1..960: mol_type = other RNA; note = synthetic construct
atggccaccttttctgtggacgacctggcacagcatgccggaactgatgtggagcgactcgaagagctgtcaagaggggtgttactgggcaacggcctgctgtttgagagcagatcacatagaaagcgtagggggggaattcgcgaaatcgtcaagcctaacccctggctggacagtattacaaagagtctgaaccggagttttttgcaggttctgccctatctaccaccggatcacgttcatgggtttgtgcggagccggtcaaccattacaaatgcgacagctcacctgggcaagaaatgtgtgctgcgagtggaccttgaggattttttcccttccatcggatctcgctgggtcaattccttgttgcagcaacagggttacgatgagaaggctgcaagcctctgcgttggtcttacaacgatcgcaggaaaactgcctattggcctgtccacctcaccgttcttgagtaatcttgccttccaggaaactgacagcgctctggccgaatttagcgccactgaggggttatctttcaccaggtacgtggacgatcttgtattctctggcgacgtcactgatgaacacctctcggccatcgaggggatcatttccaatgacggttggttaataaacctgcggaaaacggctttcatgcgccgtggtggacctcagtatgtcaccggcctctacgtgggtgggagcgatatgccaaggattccccgagaaatgaagaggtatatgagatggacactccacataatacgcaaattcggctatgaatcctatatggccgactttggcggggaagcgtctgatatgcggcctcaacgcctactcggatgggccagatacatcaccgcagtagagcccgagtttggcaggccccttctgggagctttcttcgagttgatcccactcgattactgtggcccagatgactgcgaggacatctactga

SEQ ID NO: 14341 - RNA, 969 nt, unidentified
  source 1..969: mol_type = other RNA; note = synthetic construct
atgtcattcagtgtggaagacctgggtcagcactccggggttagcgtgcggatcctcgagagtctgtctgaagatctacctgcaggcgctggaaaattgtttagagcccagtccttcagaaagaagcggggcggacttcgcgagataattaagcccaacccatggctcgacctcattacaaagaatctgcggcgatcatttttggcagtactgccataccgccccccggatcacgtccatggcttcgtgaacggaaggtcaacagtcactaatgcctcagcacatctggggcgagcttgcgtgctgagagtggatctcgaagattttttcccttctatcggcagcgcccagttaaaagcggccctccaggaacaggggtatgatgataaagccgcatccctggctgtctctatcgttaccattggtggaaagttgcccatcggtctgtcgacctccccctttctcagtaatctggctttccagcatacagatcatatcttagcagagtatgccgaggccgctggacttagcttcacccggtatgtagatgacctggtgttctccggcgaagtgagcgaccagcacctagcagccattgagaggatccttaacgacagcggctggtctattaaccagcataagaccgcttttatgcgcagggggggccctcaatacgtgacaggattatatgtcggagcaactgaccacccccgcatcccacgtaaaactaaaaggcacatgcgttgggtgttgcacattattacgaagtttgggtatgacgagtacatggcggagttcgggggcgaaaatgctgacatgcttcctcaaaggctgctgggttgggcctgttacatagcggctgccgagcccgatgttgggtacccactgctcagagccttgaacgagcaactgccacctgcctacgtcccgcctaatggctggctgatcggcatagaagaccttgactga

SEQ ID NO: 14342 - RNA, 999 nt, unidentified
  source 1..999: mol_type = other RNA; note = synthetic construct
atggccatcttttctgtcgaggacctggcgcaacatgctggggtcagtacccagacactggaagagctcgctgagagtctcccctcaggagcaggcacattgtatagccggctcacttttcctaaaaagcgaggcggctttagggaagtggtcagcccaaggaaaactctcgatgtggtgaccaagaaccttcacagatccttcctggacgtgttcagatacagaccccccgagcacgtgcatggctttgttaagggtaggtcaactatttctaatgcctcggagcacctgggacgcacttgcgtattaagggtcgacctgaaatcatttttccctagcattgactccacaagactgaaggccgccttcttggagagggtctacgatgaaaaggcagccgaattgtgtgttagagtcgtcacgattagcgataagctgcctgttggggtttctacatctccattccttagtaacctggtgtttcgagctaccgattatgctttgcttgactatgcacgcgcagaaggcctcggactgacccgttacgtggacgacctgtcattcagtggcgaagttgaggatagacacctttctgacattaccagaatcctagaggatctgggatggcgggtaaatactcgcaaaacagctttcatgcggcgaggaggtccccagtacgtaaccggactgtatgtgggggcacctgatcgtccacggatcccgaggaagacgaaacggcgtatgcggtggatcctccacgtgatttcccgcttcgggtatgagacgtacatgacagagtttggcgggctagaagctggcatgatccctcagcgattactcgggtggagctgctacgtggccagcgtggaaccggacgtgggtttcccattatttcgcgccttcagggagatccttccagaatcctataccccaccctcctactacgcgggcgagatagccggtatacggatcatacatgagctggacgatctgcgctga

SEQ ID NO: 14343 - RNA, 999 nt, unidentified
  source 1..999: mol_type = other RNA; note = synthetic construct
atggtgactatcgaggatctgtcagagtatgcgggtacaagtgtagccaaattggaaaagctggccgatagactcagagagcgcgtggatttctcgacgcatgtgtacacgacctataataggggacgccgagaaattgtggccccagctacagcactggacactgtcaccaagaacttgcatcgcagcttcgtggcagaactgccctacaatcctcctctccacgtgcacggcttcgttaagggacgctccccgttgaccaacgcagcccagcacctggacaaagcttgcgtccttcgtgtcgatttgcgcgaatttttcccaagcatcaattctgaccgagtgggaactgctctccaaactcagggtttccaaaccgacgccttagagctgtgcacccgcatagtgactattaacggcaggctgccaatcgggctctccacatcccccctcatcagcaacatcgtcttcgaacctaccgactacaccctcgcctcttactgcgaatatgaggggcttgagtttacaagatacgtggacgacatgattttttcaggcgacgtggctgatcggaatctcggtgatattaaagagatcctgttagcagatggttggctagtcaacgacagaaagaccgtctttatgaggaggggagggccgcagtacgtaacagggctttttgttggatgtgctgataggccaaggatacccagacgtataaagagacagatgaggcgggtttgttatctgatcgaacagttcggctaccagagctatatggaggactttggcggagacgatgcaagaatgattccaaatcggttatatggctgggcccggtatatcgcgagtattgagccttctgtggggtaccctatgctgcggctgctgtcagagcatgttcccgaaaaaaacgcccacagtcttgatcagacacgattcgatcacattggcataactgtaccccggatcgtggagtccctggacgacctactgtga

SEQ ID NO: 14344 - RNA, 1014 nt, unidentified
  source 1..1014: mol_type = other RNA; note = synthetic construct
atgctcgtgtctctgaaaagaatcgcttctgtcgctggctcttcggaaagcgagctccgtcaactcgccgacgaagttgaggaaggccagcactttcacgtgtatcgggctcggctgagacgccgcgatagaagcatctattggcccgacacaccctatgacactgcactgaaacagattaggcctgccctggagagactgctttcatacgaggccccacaacatgtgtacggtttcgtgaagagaagaagtaccagacagaatgccgctaatcacctggatgcagactgcgtgctaacaatcgacctggctgacttctttgcctctattaagagagaggcagtgatcggagcgctgggtgacagcggagccgataaggatgccagcgaggtaattggcaggctcactaccccacggggcgttttgggaatggggctgtccacaagcccgtatctgtccaatcttgtgttcctccgaacggacgacgaattggcatcattagcgacttccctggatattcgctttacacggtacgttgatgacctgacattctccggagccatagatgacaaaaaagcggagcatataaaggctgtattgatcagcaacgggtggactgtgaacgaccggaaaacccgcttcatgagacgaggacgtgcccagtatgtgacagggctgtccgtcagtgatgctgtcgcccctcgtgcacctaggcggcttaagcgacggatgaggtggaggttaaacatgatcgagcgctacggtttttacacctacgttactaggtttagtgggggctctgtggatagtatgttgcatgaagctgaaaggttgagggggcttgcacagtatatcgcctccgtcgagcccaaccttcgctcaggctggctggaacggtggtaccgagctgtcccaaccacctcacaccgattcgataatgagggcgacaccacgcgcttaattaagctagatgaagacgacataaggcgcctcctcgaggatgaggcccagtga

SEQ ID NO: 14345 - RNA, 963 nt, unidentified
  source 1..963: mol_type = other RNA; note = synthetic construct
atgattccggtgacccccaccgtcctcgccaaaagacttggccactctgtgcccacattagagaatctggcacagatcgttcagtcaggtccaagtgatgatagctacaggctagtgcgcggagacagggaacttcgagtgcctactccccaactgaaggtggaactgctccccgtcgcggagtacctgagagcctctcttccgaggcctgcggagcatgtccacgggttcgtcaagaaaaagtcaattctaactaacgccaaagagcatctcggcgccccagtggtactgcggctcgatctgcgtaatttcttcgcaagcatccagtctgatatggtccatgctgccctgacgaaacacgcgtccttcaccgacgacgcggcacatctcctcgttgcagtttgcgtccctgagggccgattacctttgggattttccacttctcctgccttatcaaacctcgtgtttgacgagacagacagggccctggagacatgggccagtgccaaccacgtggcactcactaggtacgtggacgatatcgcagtttcgggccacgtagacgatcgccacctggaggatctgacgggaatactgaatgaacatcactgggtgctgaacgaaaccaagacattgtttatgcggcgtggaagatcccagtacgtgaccggtctgagcgtaagcgacccattgcaagctagggtgccccgcgcccttaagcggagaatgcgagctaaactgttccttatggagaagcatgggttcgacgcttatatgaagagctttggcggggatgaccggggagagtgtccacagcagctgttgggccacgctagatatatcgccatggttgaaccaaaactcggtggcatgttgctacgccggtttagtctggctattgaagaatccgcttatgcaggggaccctgaggaggggtgggaagcttgggccctggatttgtga

SEQ ID NO: 14346 - RNA, 975 nt, unidentified
  source 1..975: mol_type = other RNA; note = synthetic construct
atgaatatttcacgcagggcgttggcagcccggttactcgtgagcaaccgatatcttgacgaagcggcctcacgggtcactgtcggcgatgcttatattctgttatcccttcatcgcagaagaggagaaactccacgtcaaatcttcgtgcctgatgcagccacagcctttctcgtgaagaaatttcacgaatggatcaccagtgtgggcccccgtcctccagatcacgtatatgggtttgtgcgggggagatctcctttggaaaacgcgaggcagcacctggctaaacaggctgtgctgcggattgacctgagggacttcttcccaagcatctcggcccagaaggtaagagaggcactcctgtctgtcggtctggacgcaagtgcagccgaggttgcgacaagaatactgaccgtgaatgatcagctacctaccgggttcgctagctccccagccctgagcaatctggtttttcgtgactccgacatcgctatttcctcatgggccaaggatcacggtttgacgtttacaaggtacgtcgacgaccttgtattctctggcgagatcggaacagaagctgtttcagccgccgtggctatggtggagaaaactgggtggcgcgtgaacactgacaagacccgactgatgaaacgaggcgggaagcagtacgtgaccggattagcagtcagtgatcccgtcaggcccagaataccgccctccaggaagcggagcatgcggatgaaactccacctgatcgagcgcttcggctacgaaaggtacatgcgcgagttccagggggaggaacggggtgatacgcctggccatttgcgaggtaccgccaggtatatggctggaattgagcaacccttcggcagcaacctgctcgcccgcctaaatgcagttcttccggaatactggagtatggaggacagatctgatccagattggctcgagtggctgggagactttcattga

SEQ ID NO: 14347 - RNA, 1764 nt, unidentified
  source 1..1764: mol_type = other RNA; note = synthetic construct
atggttggcgccgtcgcttttgaatcctccttcgagcggacagaaaacctgatcgccgacttatatgaaggactagtcagcgagtcttacctggacggactcgactcctatgagcgatttaaaaccgaaggcttccacgcctggaacgacacggctgaagtatccactgccttcgtgaggttcctgagtcggaaccgagggtacaagagttacatctatttcaccgaccgtactaccaggccagatctcggggccgaccaaatgcacgctattctgtatcgcgacttactccgcaacctgtttcaagaatatggcagcaggagactgaggctaattttcgagcagaatcacaagctggactttgagctgatagcgacagaggcagccgagataagcgccgtaaggcccccgtacagcatcgaagttggacagaagagggcccctcactccctgtcaatcgtggattatgctatggctatcttttcacgatggagagatacagcctactccaccagccctacaaccaataagtttcgctcttggtgcgccattcggaggtgggtggctattgtgagaagtgtcgagcagggcgccctttacagaagaggccacccagtggtatccgaggaacggggggtggagactctgacaagtgaacttaacgcccgcgactcacggactcaggatgggaccttaagctctcagccgccctctgtagcaggaccgtctccagcccttgagcccctgggtaggactgagtttgtcagatccctaggcgtggattcccagatcctggaaagcgtaggcgcagcagttcgggagggacaactgtacagggtgcagcaaattcggaagagaagagggggtcttcgaaagatttattctccatccatagaactcaaattgattcagaaactgatcagagaggagttggagtccgctttagtgtacgaggaccaccctaatgtgttcggctacattagcggtcggagtattatcgataacgcccgggttcatgttggcgcatcagtggtgcttcgcgtggacctcagggacttctttgcttcgataacgtcagaccgtgttgcgcgcgcgttgattgatcacggtgcaacacaggacctcgtctctctactggtgcctgtgctgaccgccgatggaatactccccgccggtttccccacttcgccattcatctccaatctggccttcagacatatggacgaggcccttttggagttgagcaattcacatgggcttgcatatagtcggtacggggatgatctcaattttagcggcgaaatcgatcgcgatgacgcttttctgaaactggtcgaacgcaccctggagttagatggctggaccgttaaccaaaaaaagacgagattcatgaggcgcggggggagccagtatgtcacaggcttgtatgtgggtgactctgttccccgggcacccaggaggaccaaacgtgctatccgcgcgcagtctcactttgtgtcaaagcatggattcgatgacatcgcacaggcgagagggcaccgcgtgaacactcctgctcgactcgcaggatggctgggctacctccagcgttttgaaccagacttcgtcgacaatatcttgggagtgggcgtcctgacactcgaagatgatcgggctggtagccgtgcagccgtcgacagttctgcccgagggtgggatgagtacctgtcaagaggagtgctcaggcatggcaagggaagcttgcatcgagctgatcctagttga

SEQ ID NO: 14348 - RNA, 981 nt, unidentified
  source 1..981: mol_type = other RNA; note = synthetic construct
atggacatccgagcttttctccgacctatcgggttgacggagccacagctacgctccctgggagatgaaataagggccggtgcccgttatagcaagcggagagttcgtaagaggcatggcggatacagagatatcgccgtcccagatgtcgagctgaaggcagccctgaagctgctgagaatacgcctcgagtgtgttcttccatacgaagcgcccgacatggtgttcgggtacgtcgcaggcagaagcatcgttgacaacgcgagccagcatctcggccaggcctgtgttgtgtgcgttgatctagtggacttttttggggccatcaatggccgccggctagagagtgccttgctctcccagggcttagcggaggacctggtgcagcttctgctgccgattcttgtggtggacgattctacccctccgggtttcagcacctccccaatgttatcgaacgtagtattcgaggctactgacagggctttagaagaactcgccggcgagcaacgggttaggtattccaggtatgctgatgatctgacattctctggtcaacacgtggatgactctctggtcgctcgggtggatgctgtgctcctgcgccaaggatgggtgctcaatccacggaaaactaggtttatgagaagaggagggcctcagtacgtgacaggactgtacgtgggagatgcagctaggcctcacgtcccccggaggattaaacgccgactccgggcatggttccactatattggcgagtttggctactcagactgcgaggcaagagtcgcacttccctcagggcgccagcttgaggggtggcttcgacacgtgaaccaggtaaatcctgaagtggtccgttcaattgtgaacgacctggggcatagtgatttgcacgtagccttcggtgccatgggactggaactgaaaggcccccccagagacgactgggacgaactgctgggcgaattgggtttgtga

SEQ ID NO: 14349 - RNA, 981 nt, unidentified
  source 1..981: mol_type = other RNA; note = synthetic construct
atgattgacctcgccgatctgggctccgcaagtgctctggatgctgatgagttcattcgctggtctaatctgattgccgccggttctggatattctaggatgtctatcccacaaagacggcggcgccctagggtggttctacgaccagaggtggcactcgacagatttctgaaacagcttacaataggactaagtcgtatcagcggatatatgccgcccgcagctgtgcacggctttgttaccgggagagacatcgccactaacgccgccgttcatttggaccaggacgtcgtgcttagggtcgacctcaaggatttcttcggcaccatcaacgaacaacgtctggtacgcgccctgggcgactatgaattcgatgaagatgctgcagacgctgtggcgggagtggccttagtcaatgatgctttggcccaggggtttagcaccagcccatttctgtcaaatatcgtattcacggagagcgacgccgagttaacaagcttcgcggctcgggctggtgtcagttacactcgatacgtggacgacctcaccttctcaggtccctacgagtccgtgaatgatgagctcctggaagccgcatccgcactgctggccgacttagggtggagcgttaacactggcaagacaagatttatgcgcaggggcaagcctcagtatgtgacagggctgtacgttggggattcagccggaccccacatccccagatccatgaagcgcctcctgaggcgggaggtgtactttgcatctaaatatgggcttagggacgcacggttgtcgtccccgacccctatgctccatgaccgacttaatggctgggtccattacgcggctcacgtggaccctgtatttggtaaaaagctgctggtggcctggaacgacgtcgcaagtcggagatacgcggatcgtgagtcagccgaatgggatgctattttggaagatataaacttcccagaggattggtga

SEQ ID NO: 14350 - RNA, 978 nt, unidentified
  source 1..978: mol_type = other RNA; note = synthetic construct
atggtgtccattcgggcagtggcgcatgcctcagctctcgatgtcggtgaactgcttcattggcagcaattgataagttcaggcgcaggctatacgagaattactattccacagaggcgtcgacgcccacgagaggtcttgaggcctagcgtcggcctcgacagagtgctgaagcagttgaacatcggactggctcgggttagtaattacagccctccccatgccgtccacggattcatcagaggcagggacattcggaccaacgccgcacagcacctggataaggatatcgtgcttcgagtagacctgcgcgacttcttcggctccatcgatgcatacaggcttactgacaccctcacaggattcgggtttgaccaaaacgcggccagcgccgttttaggtgtaacaattgttaatggcagcttggcccaggggttttcaacttcgcccttactaagcaatatgacgtttgccgacgccgatctggcactgatgaaactagcggccgatgtcggagtgtcttactcccgctatgttgacgatcttactttctccggcagctttggggaggtggatgatagattactgctcagaatcacagacgtgctcgaaagtgctggatggatagttaatagcaacaaaacccggttcatgcgaaggggtaaagcgcaatatgtaaccggtctgtacgtgggagacgctgtggggccgcacattcctcggagtatgaagcgcctgctccgcagggaagtgtattttgcctcaaagtttgggatagacaacgctagactccgctcccccaccccaatggagcacgacaggctgaatgggtgggtgcactacgctgcccatgccgatccacatttcggccagaacctgagggacgcatgggctacagtcgactcccggcgtcccgcttctagatcttctgcacaccgggtgcagatcctggatgagatcgatttccctgagtcttga

SEQ ID NO: 14351 - RNA, 990 nt, unidentified
  source 1..990: mol_type = other RNA; note = synthetic construct
atgttcgaggtagacgtggagacactggcatcggcctcatatatgaagtcagccgatgtgctggtgcggtggggggagatgctccttatcgaaggcctgggctacacgcgcatagctgtgcctcaaaaacgcaggcgaccaagagaagtgttaagacctaatatcgggctggaccgggtgttgaagcacctacgactcggcctggcttccaccagcgggtatgaagcaccagatgaggtccacgggttcgtccagggtcgtggtacggtaacaaacgctgcctgccacctcgcgcaggatgtggttttgaaagtcgacatcaaggacttttttgatagtatcgggtctgaggaagtctgtagcgccctgactaggttcggcttcaccgacgagtgcgccgaattggtcgcctctgtgaccctagttgatggaaagctggctcagggcttcagtacatcccctcttctttcaaacatagccttccacgcaaccgacgaggctctggcaggattcgcgcatactcggggagtgacttttacacggtacgttgacgatctcgccttttctggaaccaaagacgctattgatgatgagttcctggaatccttagatgtacagctgggcaatgtgggatggaggatcaacccagcaaaaactcgcttcatgcggaggggaggcccgcagtttgttacaggcctgtacgtgggggaccatgcaggtgcgcacattccccggcccatgaaggaacgtctccgcagggagctttattttgccgaacgctttggtgtgagcgacgcaaggcagagaagccccagacccatgagtattgagagactcgccggatgggttcattacgctgctcatgccgatcctgctttcgggttgcccctgcgagacaggtggcaaagaatcgccccggccctggattcctatgtccctggcccagactgggacttactagacgatattgagtttccagatgactggtga

SEQ ID NO: 14352 - RNA, 978 nt, unidentified
  source 1..978: mol_type = other RNA; note = synthetic construct
atgatcgatgcagatagccttgcacaggcaagcggaatgaccgccggctacctagcacatttgggcgacctggtgcagaatggaaccggttactctcacgtggtgattccacagaagcgccgcagaccccgcgaagttctgatcccaagtgtggcgctcgacagagcgttgaaacaactgcgaatcgggctggaaggacgtagctcctatgaaccacacgacgctgtgcatggcttcgtcgctggccgggacatcgtgaccaacgcaagccagcatttggggcaagacgtggtgctccgagtagatcttgctgatttcttcggcagtatagaccgggataggctgaagtcctccctgggtagtgccgggtttgccccttcgtctgctgaaatgatcgccaatgtagctctcgtgaatggggccctcgcccagggattttccacttcaccccttttgtccaacatgtcttttcaaaacaccgacaagatgatttctgatctcgccaaccagaaaagcgtcacgtatacacgatatgtggacgacctggtgttttctggtgatatgtacgccgtcactgatgacctgtcaaatgcgattgagactttactgcaggaagagggatggaaagttaacattaggaagacgcggtttatgaggcggggtaaatcccagtatgtgacagggctctacgtaggcgatgcagatcggccccacatcccgagaggaatgaagaagagattacgccgcgaggtttattttgccagcaggtacggcctgacagatgcccggcagcacagtcctactccgatggacccaaaaagactgggcgggtgggtccacttcgctgcatacgctgaccctgtcttcggcctaccccttagagagacatggagggctgccgttaggtcagatcctccacccgagtcacgtacctgggacagcgtcctggccgacatagggttccctgaggactggtga

SEQ ID NO: 14353 - RNA, 981 nt, unidentified
  source 1..981: mol_type = other RNA; note = synthetic construct
atgaccaccacccgggacttggccactcacggaggaccttcaccgcaacagtatccattctgggctgccgtgttagccgcaggccatggttattctacattggccatctctaaaaggaagagaagagagccacgggtggtgctaaggcccaacgtcggccttgataggtttctcaaacaggtgagcaccgcgctcgtagctggactggacttcgcccctcacgacgcagtccatgggtttgtggccggtagaggcattgtttccaatgccgcacagcacctgtctcaggatgtggtactgaagctggacctgcgggactttttcggctccgtccgcagagaaccactgactacagctctggtgcaggccggcctcgatgagccaacagcgagcgaagtcgcagcagtggtgactgtgaacggctccctgccccagggattcagtacctcaccactgttgagcaatgttgcctttgatcctactgatgacgctattcaagcgatagctgctagtcggggggccacttactcacgttacgccgacgacctgacattcagcggcacgaacggggcagtcgatgatacacttctcagcgacgttgtctccgctttagaacaccagggctggatcgtcaatccgggaaaaacgcgcttcatgcgcagggggcgcgctcaatatgtaacaggactcagtgtggacaccgccgatggtccacacgtacctagggtgttcaagcaaaatcttcgcagagaaatctactttgccacccggtacgggatctcagatgcccgagtgcgatctccccagcctttacgggagtcgcagctgcatgggtgggttgagtttcttgcgcacgtggagccccatcgtcgtgctgagctccgagaggcctggaagatcattgctcccaggccttccgcacgcagagttgagctatgggatgaactgttggacgatatagacttccccgcaaactggtga

SEQ ID NO: 14354 - RNA, 987 nt, unidentified
  source 1..987: mol_type = other RNA; note = synthetic construct
atgaccgtggtgcagcagaagttagtctggcgctctctgaaatggcaattgcaggtggtcggctcaatgaatggccgactgccgaccactagtgagagctcagagtggagacaatgggctatggaacacgcccgccctgtgcgattcagggggagagacggatggcgctccgttggacctcttgactcccttctcaagcgtatgaccgccgcgctgcagagcctatatgtggcgcctgattccgttttcggcttcgtgagtgggaagtccacctattccgccgcccaagtccatgtgggtgccccaagcgctttggttgtcgatctgaaggatttctttggtcaaatatcggaacagcgcgtcagagatgctctcaatccactgctcgacgaagaggccctggacgtgtttgtagggtgctgtcttaggagcaatacactgccattgggctttaggacttcgcccctaatcagcaacctggtgttccgggagacggaccgggacatcgagcgcttatgcgcagctcgggccgtaaaatacactcggtgggtagatgatctggtgtttagcgggagcgcagtggatgacagtttcctccacgaccttctcgcggtcctggattcacatgcctggctgccgaacgaaaagaaaacaaggttcatgtctacacgtagggtggtgttgggattaaacgttgcacagtctctcacacggccccacgttcctagaggcatgaaaaaagagttgcgaaagcaggtgtactacctttccaagtttggaatggcccatttttcacacgcaggtgcctggcccctacccagaattctgggaatgattgcttacgtcaagtccgtagacccaaacctggccgcactgctcgagcagcagttgcacgcactgcccaaatcttctaggctggttgcttattctagtgctgtgggagggggcagatggcagatggctatgctcgaagaggtcggcctgtga

SEQ ID NO: 14355 - RNA, 912 nt, unidentified
  source 1..912: mol_type = other RNA; note = synthetic construct
atgctcccagcctcggcgtccttgtccgagtgggacaattgggctggggaaaatagtcgaccggttagattcagaggcagggatggatggcgatccgtcgggcctctggactctctgctgaagcgcatggccggaactctgcagtccgagtactcagcacccgatagcgtttttggttttgtccccggcaggagtaccttttcagccgcacaagtacatatcggcgcggaaagcgcgctgacagtggatctgaaagactttttcggccagatcaccgaacagcgtgttcgggctggcttgggtcatgtactcgatgcagaggccatggacgtctttcttggatgctgcctgcgcagctccacattgccactcggattccgcactagtcctgtgatttccaatctggtgttcgccgagacggactataagatcgaggagttatgtgcaaggttatcagtgaagtacacccggtgggtcgatgatctggtgttttcaggccccagcgtggacgacgccttcctagctgaagtcctggatatactaacttcttttggctgggtgtgtaacgaaaagaagacccggttcatgtctacacgtaggttcgtgctcggattaaacatcgcaaagggactcgaccgacctcacgtaccaagaggtatcaaacgcgagctgcggaaacaggtgtattacctgaggaagttcggggttgcccacttcagcaacgatagagcctggccacttccgcggatacttgggatgattgcttacgtgaaaagcgtggatcccaacttggctctcagactggagcagcagctggtccaactgcctaaagacccccttcttgccgcttattctagtgcagtgggcgggggtaaatggcagctcgccatgttgtctgacattgggatgtga

SEQ ID NO: 14356 - RNA, 927 nt, unidentified
  source 1..927: mol_type = other RNA; note = synthetic construct
atggtatacatgttgccccggcgggctctgctcattagctgggagatcttcagcgtgagaatccagttagctgacctcccccctagaagtgcgcctgagtgggatgcatgggcccgcaaaaatgaacgcgtcgtgtctttcaggacgaagcatcggtggcgccaagctcgaagggcaaccggtaggctggacagcgctcacaaacaggcccgtgcacttctagcagccggatgggcaccgagtgctgccgttcatgggtttgtcaggacaaagtcaactaaatccgcggcaatggtgcattcaggcgctcgcgcagccctgactcttgacctcgccgatttcttcggacaggtcacatttaaccgcgtggtggataatctgaggatgagattcgatgaccggtcttgtgactggatagaaggcgcgtgctttcgtgacggagccattcccctcggctacagaacctcacctgctctgtctaatttggccttttccctgacagatgacgagatcgcagacgtggccaggagacacggtgtggcctatacccgttgggtggatgacctgaccttctccggggccggggtaagcgatcagttgttagccgatgtccagaggacactagccggccaaggctgggcggtcaacgacagaaagacccgctttatgcggcggagtccctacgtccttggcttgtacgtgggtcatgacgtggatcgaccacgcctcccacggcgaatgaagcagaggctccttgtggaaacttatcacttctccagactggggtttgaacacttttcgcacgaaggcgttatgagcccttcaaggctgttcgggagagtagcttatgcctccgtgattgagccagagctggctgagctgctgaacgagcgggttgatgctggacaccgagttggaagatcttga

SEQ ID NO: 14357 - RNA, 906 nt, unidentified
  source 1..906: mol_type = other RNA; note = synthetic construct
atgataacctggttacactttagtgcccgtcttggtctgtatgatcttgagccaaggtcggcgagcgattgggcaacctgggcaagccggtatcgagtccccgttagcttcccggtcaggggaggtcgcagggtgacagtaaggagcgtcgggcgtttggacctgagtctgcgggcttttaagtctctgattgccgaagtgtcgttcccacacgcttccgcccatggatatgtgagaggccgcagcacggtatctgctgccacaccccatgtgggtagcagtctcgtgctatctgtggacctgaagaatttctttggccagatcgacttcgctagggtgtcccctgtactggaggcttcttttgatgctcaggtgtgccagtggatcgagggtgtttgtttcgtgtccggatccttgcctctcggctaccgatcttctccggccttatccaatattgcctttgcctccgccgatctggaaatattcaactttgcggcaaaggccggggtcgagtatacccggtgggttgatgacctgtcattttcaggcgaaggagtgggcgacggcttcctcgaagggcttcaggcattgctggccgacgaggggtggctggttaacgctcggaaaactcgttttatgaggagagcaccctacgtgctgggcctctatgtcggccgggatgctactgagccaagattgcctcgccgcatcaagcaaagacttctcctagagtcatactacttcgcgaagtacggaatgagtcacttcgacagaccatacgtcctgccccctctcaccctgttcggatacatgagctacgcctattcagtcgaacccagactggcaacagttctcggggagcgaattgtgaaagggatcggcaaatccgggggacggttacgctga

SEQ ID NO: 14358 - RNA, 972 nt, unidentified
  source 1..972: mol_type = other RNA; note = synthetic construct
atgacactctccagagtgcgggagctggaattaaaaatgggctacgccccaggatccctggacagacttgcgaggatattcgatgccggagcaggccactcagtaattcgaatctctagcggcaaatccaagaccaggcacgtggttaggccaactgtggcactggatgggatgttgaaatcactcaggcgagtcctggaagccgaattggggttcgaacctatggactgtgtgcacggctgtgtccgcggacggagcattttaacgaatgcaagtatgcacctcgcccgtcccgttgttctgcgcgtcgacctgaaggacttctttgattctatcagcacttcagacatctctgatgcgttcaaggtgttggacgtcgatgacgaaaccgccgagctgctggctcgatgcaccaccattcatggccgcatgcgggctggcttaagcaccagtcccctgctcgctaacttggtgttcaactcaactgatagggatctccaagagatcgccgcccggctggatcttacctataccaggtacgtggatgacctggtgttctccggagagacaatcaccgatgacactctcgccactatagcagaacagattgttgctagagggtggacaattaatgcccgcaagacgcgttttatgagatcggggggagctcagtacgtaacagggttatctgtcgatgtggagtccggtccccatcttccgagaagaatgaagagatttctacgcctggaagtacactatgcgacactgcatggctttggaagtggtagcacagggaagaggcggcttataggcctcatcaactatgctaaatgcgtggaaccttggctcggtgccgagctgcatgactctatccgggaggcaggactgctagtgggtcgcagcgagagtgaggatgcatttgaggacgctgaagacttttgggacgagcttggcttgcgtgacgagtactga

SEQ ID NO: 14359 - RNA, 963 nt, unidentified
  source 1..963: mol_type = other RNA; note = synthetic construct
atggcggtcactgtggaccagattgaacgtatgatgggcgtcccacccgggacactcgacaagacggcacggattctggaagctgaaaccggattcacgatactcaggataccctcacgaaggggcaggttccgcagggtggtccgtctgaccaccaccctcgactcaatcataaagggaattcgcagatccctggaggcgcaactgtcttttgttcctcgggattgtgtgcatggatgcgtgaagcagagaggaattctgactaatgctagagcccacgtaggaaagaaagttgtactcagaatcgacatccggcggttctttgagtctattagcgtgagccaggtggaagatgcactgcgcacaagcgaggccgatcccgagtcgagcgctttagtcgctcgctgcaccactctgggtggtttcctgcctgtaggattctctacatcccccttgttagccaacatgattttcgatgggacagacgcccttttgggggactgtgccaagagctactctctttcatacaccagatatgtcgatgatctgtcctttagtggcgaacatctcgatgatcaaatccgactggagatcgaaggcgtgctaagatcccaggggtgggaaatccaggatcgtaaaactaggtttatgcgggcaggtcatgcacagtacgtgacaggcttgagcgtgaacgaccctaacggcccacatatcccacgcaatatgaagaggtttcttaggcttgaggtgcaccacgtggtccgaagtggcttcggcgccagtgtgctgggtaaaagaaaactgctgggccacattaatcacgttaaacacgttgactatgacctcggcctagagctgcatgacgccatacggtccgctggactccttgttgggcgccctgacgacgagtctccggaggatgggttagagttgttttgggaagatatcgggatcgacttctga

SEQ ID NO: 14360 - RNA, 978 nt, unidentified
  source 1..978: mol_type = other RNA; note = synthetic construct
atgagaagcgcagcccgactggggtttgttgccggtgtcagggcatctgctctccagcaaatggctctcacatttgatcgcggtcttggctactcaacgctggaagtgccaaaacggggtggaggatcaaggaccgtattgcggccagtcagtgaactcgaccacaatctaaaactgctccgcagaggtatcgatactctaagctcttatagtcctccggagtgggtgcatggcttcgttcctaagaggtccattgtgactaacgcccaagcccacctgagcaaggagattgtactccggctggatctttccgctttctttgagtcgatcaaaaagagcgccgtgcgcgaggccatgctgagattcggcttcagtgatgacgcttctaccctcatctcagattgctgttgcattcacgggtcactgcctgccggcttctccacttccccaactttgtccaacatggtgttcttacccaccgacgacgccctgcatgagtgggctggctctaggacccttacatacacacgttacgctgacgatcttacattcagcggaacagatatcacagatgatgattgtgcagagattgcccgcatgctgagcagtgctgggtatgcagttaatgcgcgtaagacccgatttatgagacgcggaggaccccagtacgtgacggggttatacgtcggcgaatctgaccaaccccacgtgccgagacggatgaagagattgctgcgacagcaggcgtattacatagctcagtacggatactccgaggcccagactagatcgtctaggcagttcaccccctatcagctccgcgggtggataaactatatgggcaccttgcacccagagttagcggcaaggctgcggtgcgccatctttgcacggttgcctcaggcaccagaaaggcccgaccctagcgattattgggacgacctgctggacgaactgcatatccccgacgacttttga

SEQ ID NO: 14361 - RNA, 993 nt, unidentified
  source 1..993: mol_type = other RNA; note = synthetic construct
atgcgggaatcagcaccccgcactttctcccatcgtgaagaagctcctatgactattctgtccgacacgctcacactggatgaccttgtcatcgccgccactctgcctgacacagctcgagatctaatggaggaacctgtccgcccatggcagctgaacaccattacagtgcgtaagtcaccgggcaaatttagacgggtagtggagccaagggacaattcactagcacgcgtgcagaaaaagctcaaagagtttctggacagggatgtgctggagccacatccctgcgtacacggttttaccagagacaggggaccgtacactaacgccctcgctcacttaaatgcccgggcagcgctgacgatcgatatatctgatttcttttcctctgtgagcagtgacgacgtgcaaagcacactggtttcgttcggggcaagcaccgctgttgccaggggaataacaaatgtttccgtctttgagaacgtattggcgaccgggttctctacgtctccagttctcagcaatatgtactttagagacactgatgacgtgttggccacctttgccgaggaattcaaccttacctacacccggtatgctgatgatctcactttcagtggagaggacgtcgatgacacccatcttgccgaaattacacgcgttctggaaagcaaagggttaagagtgaaccagaagaaggtgcgcttccaacggagtggccaccctcagttcgtcacaggatatgtcatcgcgcatagggaccaccccagagtgggtcggtatttcaagcgacagttgcgcctggatctccactacgtgatgaagcatggcctggtacaccaagctcagttacgaggcttgtcaccccaggtgcttgcaaaacagctcgccgggaggatcaactaccttatgtgttccgagagagacttggccgtccacctgaggcagaagtacggccacctgctggacgatgtggatgagaatccctattga

SEQ ID NO: 14362 - RNA, 1008 nt, unidentified
  source 1..1008: mol_type = other RNA; note = synthetic construct
atgcgcttcgcgcgggtcagttatctggtgggcattgttgtaattggtgacttccgggcgccacatccacgaaaggaggaggtgagcattctgaaagatctgaggacagctgaagagttacagatcgccgctgccctgcctgattccgcacttttgtggctatgtagacccctctcagctgaagacatctacgtccacgagatcagaaaaagcaagggccgcttcagacgcgtctatgaaccgagagacaacagcttagcccggctcctgaagcagctgaaggagtttttggacaggcaagtcttccagccccacgctaatgtccatgggtttataagagacaggtccatctttacgaatgcaaccgcccatcttggcgcacgagctatactggctgtagacatatctgacttcttctcctcaattagtcgggatcagatcactggcgccctgatcagcctgggcgcaagtgatcaggtcgccgtgtctattgcgaatgtgtgcacattcagaaacgaactagtgactggtctgtcaacctctcccgtgctgtccaacttggttttcctccctcttgataaaaattttgagtccctcgctgttgagcgtggtctgacctattctcgttacgcagacgacttaacatttagcggggatgccgtagacgaccagttgctggccgtggtggccgaacggttgtctgagcacggattcaagatcaacctcaagaaggtgcgctttatgaggaaaggacaccgacaggtggttaccggagtgtcagttgcatgcggagataagcttcgtctgcctaggaactttaaaaaacgcattaggcaagatctctactttagtgaaaagaatggcatcagccttcaggctctgcaccgcgggttctccaacgacgaagattttcgggagagtctgaaagggaagatcaatcatctaaactcggtggattcttccgccgccaaactcttcatgagccaactcaataacattagctcatga

SEQ ID NO: 14363 - RNA, 987 nt, unidentified
  source 1..987: mol_type = other RNA; note = synthetic construct
atgcaccctgtcggaataaacatcgagcgcatcaaaaccctgattgagctggctagtttatttgatgtgtcagaggagatgctacagggtttcatcgataaccacgatgaattagtggccagagtcctgatgctcaaaaaccggtctggggagtataggaaaatagtgtttactaagagcgacccttaccgtatcttcctccggacgctgagcgcattcttgtacgagtggtattcacaccgaatccctgatagcgtccacggatttgtgaagcggaggtcgattatcacgaatgctcagcagcatactcaaaaaaagtctgtcaccaatatagacatcaaacatttcttcgagagcataacatttaaggaagtgcatggcattttcatcaaagtgggtttccaagacaagattgccgggaagctgacagaactggtgactgttgacggcgtcctcgccgctggatttgcaacctcccccgtactctccaatattgcatgcttggatttggacgaagattttaagaacctggcaaacgaacacggccttatttatacccgttacgccgatgatatcaccctgtccagcaataaagagattcccagtaaggaggagattaaaaacatcctaatcaagtacggattcgagattaacgaaaataagtaccgcatttatcgacgcggcggaccgcagtacgttacagggctctccgtagttgacaaaagaccacggcttagtaagaagtttaaaagaagactgaggctcgaactttactacatcaagaagtatggctttatggaccactgggccaaggccatcaaaagggcgatcgacaaaaatacttatccatccaggttctcacaggtggcgtacggcggttgggggttggaaggctttgctgccttcattcattctgtggaacccaagcttggttctaagatattcaaaacactgctgaagcgcggggaggacgagatgtattggtga

SEQ ID NO: 14364 - RNA, 981 nt, unidentified
  source 1..981: mol_type = other RNA; note = synthetic construct
atgttccccacgaacatcgacatcggcaaaatcaagactctgagtgaattggcacctattcttagcgtttcggagtcacaacttaggtacttcctggaatctaaagagtcactgatcaaacggggcctcatactgaagagaagtgggacctttcgccgcattatgatggcaaaagacgatagctttcggcactttctgctcaaacttagctctttgttctactctaaatacgaactccacataccggccgcggtgcatggatttgtgagggggagatccattgtgactaatgcccaacagcatacccagaagaagatcgtcctcaatgtggacatcgaaaacttcttcgattcaatctctttcgaacaggttgtcgccttactgatttcctttggtttccaggagaatatcgcaaaggtgctggccgagttgacaacagttaacggcattttggctaccggcttttctactagtcccgtcctatccaatatggcatgcatagtaatggatggggtcttcaagtcatggtccaaaaaacgaaactttacatatacgcgctatgctgatgatctaacatttagcagcgagcagtatgtaccagctcagaaagaaatcgccgaaatactgggtcatttcgggtttaaaatcaacctggataagtacagggtgtataggcgaggaggaccccaatacgtgaccggtctgactgtggtggacaagaggccacggttaggccgaaagagaaagagaagtatgcgtctcgagctctattacattaagaagcacgggttcctgaatcatttctaccacgccctggaccgggccacaaagagacacgagctgccaagcaaattcacccgcaccgtgtttttcggatatggcgttgacggatttcgcgcctttatgcactccattgagcctcggcttgcgtgtaatatgcagcaggtcttaaaaaaggaggctcctaaggctcgtaactga

SEQ ID NO: 14365 - RNA, 1329 nt, unidentified
  source 1..1329: mol_type = other RNA; note = synthetic construct
atgcctggtggggacggcctcagatcttggcgtcatgcttccgcaccatttcggaggtgtttgcggcttcccaggggagcgctcaggagaattggccaaaagctgcggctcccccatagacttagaaggcgacctacacccaggaggcagaaagctccttacaccgttgatgcgggcggtgccgctgcacttgggacaagtagaccaagagatcacgttatgtgtgaaaaccctgctatggccccccccgtcccgctttttgaatttacctgccaccaatcagtcgcctctcttgaagtccccttgggcaagccgactcatgccctggagcacctggcgacgacgtgcgattcaggaggagcataccaactgaattacttttggattcgcaacaagctgcggtccgttagcgctccaaaccatcagctcgatctggtgcatcgacgcattaactctctgatcttccctgtggacctggcaatgcgccgcgaggtgaatggattcattgcacgccggagcaccataacaaatgcacggccacacgccggcgcaaggtatcttcagaaattcgacatcaaggacttcttcataaacatccgcacactccaggtgagagctgcgctccgcaacatagggttcggtccaggggccgcaaccatgctatctcgattagtaagctgcaatgaccgtattcccttgggagcccgaaccagtccgagaatcagcaacttagtgctcatgtcctttgatgacgccatgatcgctctcgccgacgagcgggacttggcctatacacgctacgctgacgatctaagctttagcgcccaagcgatgtttgatgtcagctcagaggtgagggctgccctgacatccagtgggttcgagttgaatgcctccaagacaaaatctttcaagcacggacagccaatgtttgttactggcctggccatctccgatgcatctaggccaagactacgtaaaaggctgaaatcgcggctccgccgggagttctattttgtggagcggtttggactggctggtcacgccaataagatcggggcccacccagaaaggactgcctcaagattgttaggccagttccattacgcgcgatccgtggagcctgaatttgccactagactggaggccaaatacccaaccgcttttggcgaactgattcctcagcgaaccgacgacagagtggagcgtgcacagcggtcgaggcgtgaattcctgaccgatgtggagaatgctccccagcagacgctgcccttctatactcctactgcaagtctgcctttcgtacccgcccaccgcgctgtcgaatga

SEQ ID NO: 14366 - RNA, 1074 nt, unidentified
  source 1..1074: mol_type = other RNA; note = synthetic construct
atggctcctctgactagacagttggagtttaccttccacgaaactgccgcatctcttgagagcgtgctcggcaaaccatcatccgcaatcgaagccttggcctcctcctgcgatgctggcaccgcctatgaggtgggcgtactcagtattcgacgtaaattgcgcgtcattcgtgtaccggagcgcgagttagacgccgtgcacagacgtataaatatgttcctgttccctgtcgacctgagcatgaacccacacgcacacggatacgtggcgcgcagatctacactctctaatgcctcccctcatgtgggagctacattcctccagaaattcgacgttaaggatttcttttcatccgtttcacgcgaacagatcgctggagctctgactcggatcggcctcgggcaagatgccgcacagctgcttagccggctggtgacctgtcagggggagttgcctctaggggcaaggacttcaccacggatatctaacctggttcttgccgattttgatgaatctatcggagcagttgcctccgatgccggcctgacatatactcgctacgcagacgacctcaccttctcgagtcaatcggcttttgatgtgagccacgaggtccgaacgcagctggaattaaggggttttgaactgaacctggcaaagagtaagtcttttcgctacgggcaaccaatgttcgtcacggggctcagcataagcgacaaaaccagggctagagtaagaaagaggtttaaaagtcggctgagaaaggagttctattttgtggagaagttcggtattgagggccacgcggaagccattgatgaggacgagcatcatgccagcgctcgaatcatgggccaattccattatgtgagggcgatcgaacccgattttgccgctaaacttgcagccacctacccgacagcgttccagacacttatccccgaaagatacgacgaccggattgctcgggtccagaggaagcgggacgagtttctgaccgacgtggccaggcagcccggtttacatctacctgtgtacttgcccacaactcccctgaccgtcggacgatga

SEQ ID NO: 14367 - RNA, 1071 nt, unidentified
  source 1..1071: mol_type = other RNA; note = synthetic construct
atggcgcctctcgaccctctttttgaataccgagtgcatccaactcgtgcatcactggaagcccccctcggaagagactccatgaccttggaaggcctggcagctaggtgtgatgagggtgatgcttacgtcacaggttttatgaccattcgcggaaagtccaggttcatagctgcaccaagacctgaacttgatgcggtgcagcgacggatcaatcttctgctgtatccaattgatctgagcctgggcgcttcccctcacggctacgtagccaggagatctacattaacaaatgccagaccccatgtcggcgcccggtttctccagaaatttgacgtgaaggactatttcgcgagcatcaccgcgtctcgaatcgccaccgccctgactgagttagggttcggctctgaggccgctacactgatttccaggctcaccagccatcgcttgagacttcccttgggagctcggacttcaccgcgcatcagtaacattctcctgattgactttgatgaccagatggaaaacctggcccgtgagcaggggttgcggtatacccgatatgccgatgatctagctttttcctctcagatcgccttcgacgtgagtgaccgggtggaacaggcaatacgtgccgccgggttcgagcttaaccctatgaaaaccaagcagtttaagcacggccaacctatgttcgtgaccggtctgtcgatccaggatgccactcgcccaagggttcgaaggcgcctgaaggcacgcttgaggcaggagttctactatatcgaaaaattcgggattgaggaccatgccgctgccgtaggggagagttggaggggagttctccacagattaactggacaatttcactactgcagaacaatcgagccccagtttacggctcaactaacgctcgactttccagctgcatcatcaagcgttgcaccagtgcacgaagacagccgcgtagaaagggcacagcggcaccggagagagttcgtggcagaggtcatgcggcaactgcccacagctatacccttctacgtcccgcaggccgatctgttcgagaattga

SEQ ID NO: 14368 - RNA, 1083 nt, unidentified
  source 1..1083: mol_type = other RNA; note = synthetic construct
atgtccactccagccggccctttcgattatatcctgtccgaacagcatctggctagagctctcggggtgccagtagctctgtttgaatacgttgggaacctggcagagatggggaaagcttacgagtaccgtcggaaatctatccatggcaagatccgggagctaggagtgcctgtggattcagtcatgtccttacagcgaagaattacggacttcttgtggcctttgtccttagagctgcatcccgcctgtcacggatatacccccggccgaagtgccacgactaatgcagcaccccattgtggggcgcggtgggtacaacgccttgatatcaaagacttttttccgaggacaacaccaaacatcgtgaccaaggccctagttgagagaggagcacatcagacagtggctgaacttctgaccaagctgacaaccgatcgcgggagtttgccacttggcgccccttgctcaccgctgttgtctaacctgatccttacccccgtggataatcgagttgccgatcaggccgccagcattggcgtgagctacacccgctacgctgacgatctgacattttctgcagacgccgaattcgacatgaccggagtggtccagtctgcgctccagcctctgggatacacgctcaatttagaaaagagccgcttacggcggcgcggtcagtcaattgccgtcactggcctgagggtcgccgagatggatcaccctaggctccccaagcgttttaagagagaactcagacaggagttctatttcatagaaaaattcggctttgccgaccattgcaacacacgttatttctggcactggatagacgaggaagacgacgagaaacaactggaccacagtactagacacctccaaggtaaggttaggtatgcactgggagtggaacccgactggatgagggccctacttgatgcccacccagtggctgcgagcgagttgactccgcccaaaagacaccaggctgatcaacggctggcggctctcactgcactggctgcagagattgtcggtaggcgccacgtatcgctgagccgagagccaaccaggctcggttga

SEQ ID NO: 14369 - RNA, 1101 nt, unidentified
  source 1..1101: mol_type = other RNA; note = synthetic construct
accggcccatttcaattcaggggaaccaatgccctgttcgctacagcgttaggtctgactgccgagcagcttgaagaggccattaagctggccggcgaaagatcaagttaccagttccggacagtgcgcaaacggggaaaagaacgaacgttcatctctccacgcgcccccctacttaacttggcacagaggagggttgccgattttttgaggccctttaacgagctcctgcatccagggtgcgtgggatacgtgcctgggcgaaggactctggacgcagcaactcctcatagcggcaagccttgggtccagaaacttgacataactgacttttactcctccgcgcaggatacaatcatacacgacaccttcgtctctctgggggctactcaggaggtcagcgagactctgacctcccttgtaacatgggagggcgtcttaccgaccggcacaagaacctcccccgtggtgtcaaatctcgttctcgctgatttcgactttgaatgtgctgcagaagccgaaaggagaaatttagcatatacccgctacgcagatgatctgattttctcgggcgacgatccgttcgatatgagtggatgggttgaccaccatctgcaagcgattggatttaagctcaaccctaggaaatccgtgctgtgccgtagaggccaacccattcgcgtggctggcctaacgatctttgaaaaggacagaccccgccttcctaaagcgttgaaacggcggctgcgtcttgagatctatctcgtcagtaaggacctagccgctggacactttgagtctcctggggacgaggatgattatcctccagaagtagaggaggcccgcgctaggttcttccacgctcaggggatgctgcggtatagcgccggaatcgagcccgcctttgtgcagagcgcactcgacaagcacggtgaagagttgagagatctgctgctccccgccagacggagacatcgggacgagctggaactgcgacgcctcctcgctaagattctgggtacacgtgcaccaggtttgggccgaaccccgtctcccatcccttcagccccaccaatctcacgggtgagcagcgttgggtga

SEQ ID NO: 14370 - RNA, 1068 nt, unidentified
  source 1..1068: mol_type = other RNA; note = synthetic construct
atgaccccacgtaccagcccagcatccaccttaagatctcccaggcatttggagttgtatctaggtgccccactctcggcactggaggccatagctgcagatctcgctgcgggcgtaggcgttgaagtggtgactctgagaagtaaaggcaaggcccgagagattacatgtccgaccgatgaaactgtgcgcaatgtccaccgacggatactctccatgatgactcctgtgcagatggaccttcccgacatggttacaggctatgtccgaggccggagttcagtgtcaaacgcccaggcccatgccggaggagcctttctgcaaaagttcgacttgcgtgacttctttcaccacatttctagtgacgcagtcgcgacagggctgagagacgtgggattccaggcggaggtcgccgcattacttgccggcctgactacatgcaggggactcctgccagccggattttccacaagcccagcaatggctaatctggcttgccgcgcattggatgaagatatcgccgccctggcggacagtctcgggttaatcgtcacgcggtacgctgacgatctaaccttcagcggggcccagttcttcgatgtgaggtcagacatcggggtaatggtgaaagcccactcacacgtgctgaacgaggaaaaaacaaggaccctgaagagggggcagcccatgtacgtcaccgggctgtctgtaagcgagaacgacagacctcggctccctcgacctttcaagcgcaagctgaggcaagagcttcattatatttctgtttttggcctagcagaacatgctgacagacacggagtgaaagttgagggtctgcgctttcgcctcggtggccagcttgcctatgccagcgctgtcgagcccgatcttgtgaagtacttcgaagctcattttcccgctgcataccgcgatgtggctcgggcacggtcccctatcagcgatgacaaaagaagaactaggctggcccagttggccgctcgtgttgctgcacggtccgatccgctggctgagatgtacgaacccaccgtgacgatcgccgcgctctga

SEQ ID NO: 14371 - RNA, 1062 nt, unidentified
  source 1..1062: mol_type = other RNA; note = synthetic construct
atgacaccacggacctcttccgttagcattctccgcactcctcggcatcttgaagtgtacttaggggcacccctcgctgccctggagagtattgccagaaatttggatgtaggcatcggagtggaggtggtgactctccggtccaagggcaaggccagagtaattgcctgcccgacagatgaggccgttcggaacgtccacaggcgaatcctcagcctcctgactcctgtccagatggacctgccagacatggtcacaggatacgtccgtggaagatcatccgtgacgaacgccatcgtgcatgcaggcgctgcccatctgcagaagttcgatctacgagactttttcccacacatcggggtagacgctgttgacgaagggctgcacgccgcaggcttccaagaggaggtcgctaggttgctaagcaggttaacaacctgccgcgggtatctcccagcaggtttttccacgagcccggccatagcaaatctggcatgtcagtccatggacgcagaattggcggccttggctgagcaggagatgctgaatttgactaggtacgctgatgatatcgcctttagcggaatggagccattcgatgtgcttgacgaggtgcggcagatagccattgcgcacggccacgccctgaacgacgaaaaaacccgaaccctgaagcgggggcaacccatgtacgttaccgggctgtcagtcagtgagcaagaacgacctcgcctgccccgccctttcaaacgcggacttaggcaggagctttactatgtccagacacggggcctcgccgaacatgcttcatggagaggtgctaaagctgaggcggtgaggtatcgtctgggtggacagttagcctacgctagtgctgtggaacccggctgggttgaagctcttaccaccgcctttcccactgcctttcaggaagtggccaggcgcaggtcgtcacagtctgacgcgaagagaggcgagcgtctggcacaactggctgccagagtgatcgcaagaaacgatgcagcagcggaactgtatgagccttctgccacaatttcttga

SEQ ID NO: 14372 - RNA, 1077 nt, unidentified
  source 1..1077: mol_type = other RNA; note = synthetic construct
atggagatcgaccggcgcgtaccttcattcgccgactggttgaatgaggcggatgtcgcaaatgcggtaggcatgcagctcgaaagcttagcccagacagcgagacgtttagccgaggacgagggggtggtgcactcacgtatcctgaccattagaggaaagcagcgcctggtgcatactcccagggacgaaggtgtgcgccaagctctgattgctttgatggcctccatcgaactcccgattgccaccgtcctccggagggacgaaatagcccacgggtatatcgctggaaggagtgcatactctaacgcctcctctcatgctggtgcattttggctgcagcagtttgacattaaggatttcttcccctctatctcagctacaagactggagtccgctctgttagaggctggaatgggtgcgcgcgctgcacagtttgtgactagtctgacaacctatgggggatctcttcctctcggcttcgtccccagtcccctcctgtcgaacctggttgctaccgggatcgatgtgggcctgaacgatctggcccaacaacatgggttgactgccacccgctacgccgacgacattacacttagcggcccccacgaatttgattgtaccgaggagatcgaagcaattgcccaggcctcaggattcgccctgaatcctgcaaaaaccaaagcgggcgaagccaggcacggcgcaagagttacgggtttcgtggtcagcactggctccccaaggcttccacagcacgttaaaaggcagacacgccaggatctgttttctatacaacggataggaatcgagggccaagcctccatgagagggcgaactccacagtccttggtccggaggctgctcgcacgacttgggacactacggaagtgcgagcctgttgtgtacgagaggttgaagcgggattaccctcatgcttttgtggaccttgagagctacagaaccgacgctctagcagcccgagcccgaagagcagatgccctagaacagcagctgctcctcagcagtagcccggcaccagcctattatattcccacgcacccagctggccggtga

SEQ ID NO: 14373 - RNA, 1005 nt, unidentified
  source 1..1005: mol_type = other RNA; note = synthetic construct
atgcggttgtcagctttgcaggaaattgcacagcgcttacgagcacaccccgcagccgttcatagcagacatctcctgatcaggggcaaaaagcggctggtgcacactccccgggatgaagggctcagacaagccttagtcgccctggtcggctgtatcgagttgcctatcgccaccaccatgcgccgggacgagattgctcatggttatatccctgggcgctctgcctatacaaacgcccggtgccatgtcggagctacatgggtccaaaggctggacataaagaatttcttcccctcaattagcgccgcccacgtagaggcagcgctaacagaggccggaatgggggaagacgcagctcgcttcattgtggcttttactacgttcggcggtagtcttcccctcgggtttattccgagcccgctcctctccaaccttgtggcgactaatatcgacataggacttttgagactcgccagagaacgtggactctgcgtgacccggtacgcggatgatatcactctgtccggggaggagttatttgattgtcacgacgatgtggccaccatagtcggcgagagcggcttcgctctgaacctggcgaaaatgtctgccggaacaccaaggaatggctttagagttaccgggtatgtactctcgactggcgaccctcgactgccacgacacgtgaagagagagacgcgccaggatctgtattccgtggagcgtatcggtatcacccagcaggctaaacataggggtagaacaccacagtccttcggcaggcggctgttggcacgccttggaagcattcgacaatctgaaccacttgtgtacgagcgcatgcgatctgactttcctctggcttttgagaggctggacgccctaagggagtcagctcgggttacccgtgaacagaagtccgccatgctggaaagggaactgcttagtatgcctagtgccgcacccgcttactacacacccctgcacccagcaggcagatga

SEQ ID NO: 14374 - RNA, 1086 nt, unidentified
  source 1..1086: mol_type = other RNA; note = synthetic construct
atgactccccccacacatctggaatactccgtcgtggattccgtaggtgtcttggctggccagttggggcggaccgctgaagacctgttccagatggcggaggagatcgcttcaaatgttaggtacgaaacgcaggccgttcggatcagaggcaaagtgcgaatactcaccgtccctgacgatcgactgaaatacctgcagagggacatttgcgaattcttaatcccggccaacgatcggctgtcgccagaggtacatggttttgcaaggggcagaagcaacagatcaaacgccatcagccacgctggacgcatttatattcagcggtttgacttaaaggacttcttcgggagcgttaccagcgcacaagtgctggccgcctttcgcgaactcggactaagtgacccagcggcacacctactcaccgaacttacgacatatcgtcgcgcccttccacagggagctcccacaagcccgatcttgagtaacctggtgatgagggaggtagatgaccgcatgagagaactggcccactcccgcagtctgtccttttcccggtacgccgatgatatggcgtttggtggcaatgagaggttcgacctgtcatcagaggtcgaggatattatcgatgcttatgggttccgcctgaatgacagcaaaaccgcatttgccgggcctggccaacctaggttcgtgaccggactctacattgatgaggaccgagtcaggctccgtaaaagttttaagcgtaagctgacacaaacactccactacgtggaaaagttcggcatcgatgaccatgcagacagggtgggaaaagcaccatccaaggcccaggaacaactccggggccgcatacactatgctagacaggtggagcctgcatggcttgataagcagagatcttctttcccccgaactcttaatgagctggttccaatgaactacgaggccactagaggggagtacctgttagctcggagacagggatttctttctggcatggccgggatgactgccgcgtctgctttgcggtatgtgcccgcagtgtcttatgccgaggtgaagagccctgttgtggtctga

SEQ ID NO: 14375 - RNA, 1665 nt, unidentified
  source 1..1665: mol_type = other RNA; note = synthetic construct
atggaagattactggtacattgtaatcggtatggttgccctgctagtgatcttctgtctgtgcataggatttagcggcggaaagtggaactatgccgcatacataaaagaaaagaatgagcgggtccaaaggaagagatggaataaatacgttaagttcctcgaccctgtcaaggagacggaactcctgaatattatcaaactcagttcagacgccgacttcgaagccttcttgaaagagattcaacctttgctgacaaagaagtacaacccatacaacctgaacgagcagacccttcttaagaggacaatctataacgtaatcaatcgctacaccactcaatttaagtacgaccgggttaagaaaatcgaggctatacttcccatgcttaaaagagtatttcttggccctcgcctgaccaaccaggtttattctaagaaaaccctgaagcggcgttttaaattcccactaaaaagcggggtggagatccctaagttggacaccatcattgatgtggctttcttttttaacatctccgtgaacaagattctcggactgtgttacatgcaagaaaagaatccgggggcgtattacgtgaaaagggagatcatctatgatcagatgggcgagaagggaattattttacaccaaaaggaccccgctatggtgcagctggacagttcttatgccatcgcagagccgaacatcctcaaaaagaagaaatccaaccagaatgaaggcaaaaattccgaggatatccaggaaaagctggaggaaattaaacctagtttcaaagagtacagctcaccattttacaaacggaaaatgctcacaaagcccgatggaagaaagagattgattgcctgcccggtgtcttatcttaaaaagtaccagcgcaagattctgggggatatattagagaaggtggcgctgcctacaaattgcacaggcttcgtgaagaaccgatccataatttccaatgctgcgaaccacgtcggaagccagactttggtgaagatcgatctcaagaatttcttcaactcaatgaagttctaccatactttcgaagtgtttcgcggttttggctataaccgccccgtctcggggatcttggcttgcatctgtaccgattggtatacaaagggcgggagatacgtccctcaaggagcaccatctagccccatgattggaaatctgtacgcactgcatctcgataaacgcttagaaggcctctggaccaaggctggttttgtctattcccgatatgctgatgaccttgcatttagtagttccgaccccaaagtaagggtgagagggctgatatttgccagctatcagttcattaaagacgaaaaactaagcccaaatcccgccaagactaaagttttacgaaaacagcacaagaagaaagtgacgggtattactgtgaacgagaagatcaatatcgacaggaggtggatgaatgcctttcggggcgagctgcatcgttactctaagttcggtctgccatcggatggcgtccagcgtagcaaaattttctcacagctgaaggggaaaatgtcattcctgcagatgatcgaccagaacaaggcacagaaatacgacctctattttgagaagatacggaccgaatatgccaaattgctggggaattcttcccagtga

SEQ ID NO: 14376 - RNA, 1617 nt, unidentified
  source 1..1617: mol_type = other RNA; note = synthetic construct
atggacgctttccggtactctctctatatctctgtaggttttgggctgctggttttcatctgctgtcttctgtcctcgaaaaaacgggctgactatgaggattaccgaagagaaaagtggaataagtacgtaagctttcaagacccagaactcagaaagagcctggagcacgatataatcgtgtcaacggatgaggagtttgaggcctttttggtgtcattgcgtagttctgtgaagtaccgaagggataaaaatggccttcggatacgaaagaacatctgcatgttcatcaataacatttggatgaactcctactccgagaagggtagaaaaatctataagcggttgaagaagttggaagagatcgtcccccttctcaaacgcgtgtattttgggcccaagtatacccctattatttacagagaaaggaagtacgagaagtcttaccagaggcgtaaattcaacttcccccttcagcctgatagcacagctccaaaattagacaccatcatagatgtcgcctaccatctgcagacaagcatccggctcatcctggctattatctacacccaaagtcattccagagacaggaactatgttaaaataacccagattgacaaggcattacaccagaaaggcaactcttatctgagagtggtgggcagccctattgcacggcatgtggacattgatcagagcttcattttgaaagacaagagggggaaagttcccaaaaatgcaaaaaccactgatccccaggacgcctatctcgagtacaaggaattagattcgaacttttacacacgcaaaactttggtgaagccgaatgggcggaagcggctgattgccgttcctaacgagaagcttaggtcctttcagcgcattatactcaagaccatcctagagaaggcggctctcccagacgtctgtactggcttcacgaagacaaggtccacagtgacaaatgccgaatttcatgttggcgcgcaaaccctggtgaaggtggacctgcacaattttttcaacaacctaagtcttgaccatgtgttcgaagtatttcggggattcggatacaataggcctgtttcaggaatcctcgcaaatctgtgcaccgattactatcgatcccgcaggtatctgccgcagggagccagtactagcccaatgattgccaatctgtatgctctgcacctggatagaaggttagaaggactggctaacaaatacgacctgatttattctcgatatgccgatgacctcacattctcaagcaaagatcctaagatccgtgtccgcactttcatccaggccgtgtacaagatcatcaaatcagagaaactgtaccccaattatcagaaaactaaagtgtaccgcaagcaacacaagaagagtgtgactggtataaccgtcaatgagaaggtgaatattgaccgtaagtgggtaaacgccttccgcggggaactgtacagatattctaaattcggcgtccccgaagaggaccgctttagaatagtccaccagatgcacggcaagtttgcatttctaaaaatggtcaacccagaagtcgcaaaaaagtacgagacgcaaatctccaaattcattgcggagaacagctga

SEQ ID NO: 14377 - RNA, 1575 nt, unidentified
  source 1..1575: mol_type = other RNA; note = synthetic construct
atgctgttagagggcttgtccggcgaggcagctggcttgatcatcattgcattcatgatattcgtgttttgtctttgcctggctaagctcctcggctattcagggtatcttcacggtgattatcgttggaataagtacatcaaaagcaatgaaccctctatagagaaagagatctactacaacatacaaagcctgagcgacgagtattttaaaacctacctgcagagtatcaggaagaccatcaattacaagtttcgaactggcgacaagagcctcaaaaacactattttgaagagatccatgttgaacatcataaacaagcatacaaacgagctgccaaatgagcgtatcaagcagattgaagaaatttttcccctcctgcgccgggtgtactttggaccgggacttaacaaagaggtgtacgacaagaaacatttcaagaagaagttccacttcaagttgaaaccagagcacaccatccctcaattcaattccattattgatcttgccttgtacttcaaaatccgcgttaatgctctactgggttactcttacaaccagaaaaccaaaagaaccgcgtactacatcaagaggaagaaaatgttcgaaaactttggacaaaacacgattcctgacgactatcgttacatcaaaaaatcctactcggaactgaaggaagaaaagaagaagaagtccaagaaacagcctgagatagagatcccttcttttaaagagcttgaaagtcccttctatacccacaaatttatcgaattccctaacaaaaagcggcgactcatcagtaaccccaattactggctaaaacaacttcagctgaagattctccgggacattctggagaaagtggagataccagattactgctatggctttgttcccgggaagtcgacagtggataacgctcgcattcacttaaaggcgaacacactcattaagattgacctgctaaatttcttcccgtctctgaagttttggcatgtcctgcacgtgttcagggggatcggctataataggcccgtgtcaggagtcctggcatgcctgtgtacagactggtaccattccaagcggtttgtgccccagggagctcctacaagcccgatgatagggaacttatatgcaagcagaatggatgtgcgcattaatggtctagccaataaatatgggctcaagtatactcggtatgccgatgatttaacgttctctagtatcaacgagaagatccaggttcggaagtttattgcctcagtctaccacattatccgcgacgagaagctgtatccaaaccttaagaaaaccaaagtctttaggaagggtaataggaaagccgtaactggcattatcgtaaatgaaaagctcaatgtcgacagaaaatgggttaactcactccgcggcgagctgtatcgataccagaaattcggactgccacagggggaagaaggagatatcatctataatcagctgcaggggaaaatagcctacctgcatatggtgaacccagagaaagccaacaaattcagcctcctgtttcagaagttgagagaactgaatagaaagtga

SEQ ID NO: 14378 - RNA, 1464 nt, unidentified
  source 1..1464: mol_type = other RNA; note = synthetic construct
atggccagcgaactgacccttatcctggtgttcgtgggcctcgtgtattttctgatatttgtttgtgcggctgctgcatctaaaaggatgagatctagatatcctaaacccaaaccagggcatcgctacaggaagcttaagagggtacgtgacccgaaaattcaggcaaaagtacgggagaggctgactaagtgggaaggggcccagtacgaagagtggtacaaagacaccattaagaagatcaactacaaatatcggacaaaccagcgccagaaaaaatggaccgttctgaaacgagcagtcctggatatcatcaacaagtatacatacgagatacctgaggagcgactcaaaaaattttcccaagacttcccactcctgcggcgcgtttatttcggtcccaaactcaataagcaagtgtacaacaagaagaatttggccagaaaattcaaattcaagatcaaggatgggaccgagattccacacctagataacattgtggatatcgccctgttctttaacacatccgtcaacgtgctgcttggctatgcgtacacgcaggacctgtcaaacaagagttactacatcaagaagaactataccaagaaacggaagagaaaagactactatgagcagaagtccagattttataaccggaccacactgatcaagccagatggcagaaaaaggctgatctccagcccaaagtacaatctaaaaaaccttcagctcaagatcctccacgatatcctcgagaaggccgaactgcctgactgctgcacaggatttaaacctggtaatagtatcgtggataatgccaaaccacacataggtaagagcaccatggtacagattgatttatacaacttcttcccgtctttgaagttcgatcatgtgtttgaagtgttccgcggctttggctatagtaggcctgtcagcggagtgctggcaggcatttgcactgatttttgtaattcccctagatttgtgccccagggagctccgacttcacccatgataagcaatttgtacgcctcacacctagataagcgcttgaaaggcttatggacaaagcgtggtttcacgtatactcgatacgctgacgacctgacattcagctctgatgccgacgatatcaaagttgggaatctgattcacgccacttacgagatcattaaagacgagaacttgaaacccaattataagaagaccaaggtgtacaggaaaggacatcgtcacgaagtcactgggatagtcgtcaatgacaagttgtcggtcaatagggactggatccgagaactgcgggccgagttacataattataacaagaatgggctgcccgacggcattgagggacagcagattctcaacaagcttcaaggaaagatttcattccttaatatggttgaccccgaaaaggcagctcggtaccgcgcgcaatttgctgtgctcaccaaggactga

SEQ ID NO: 14379 - RNA, 1050 nt, unidentified
  source 1..1050: mol_type = other RNA; note = synthetic construct
atgcttgaaagtcaagagaaattggacctgaatatgcacgacagtaacaggtcaaaactgaagattaaagaactcccactcgtcctgaacttgcgagatctgattaactttctggagataagtcacagccttctggagaactacttcacattcaagagttccctattaatctataagaccttcttcatcgccaaaaaatccggtggccaccgggaaattttcatccctgtgcccaaacttaaatccatacagtccaagatcctggtggaaatcctcgagaaaattaacataagcaagtttgcacacggcttcatcaagaaacgttctattgtctctaacgcccaagagcatctcgagagccaggtcatctataaaattgacctcgtggacttttttccctccattaagtttgataaggtgcacgaagtgtttaagaagatcggttatagcgagtatatcagttacctcttcgggctgctgtgtactcatctgcgcggatacaatgagatgtcacaagaaaaatccagcttaaatctcaacaagttgagattcttgccacagggggctattacgtctccgatcatctctaatctggtttgctcgaagttagataaggacctaaacaaaattgctaggatatacgggttcagatatacccggtatgcggacgatatagcatttagctcacagtacagaaaggacatcacaaacaagttcaggaagaagatccattccataattaagaagcacggcttcagcattaatcgcaaaaaagagtgcctgtcttacaacaggaattttcagcgggtaactggaatcaatgttcagaattcagaacttagcttgcctcgaaaatggataaaaaatctgagatctgccctgcatcatctggaaaacgattacaatcagatcgatgaggagtgcattgagattatgaaaaatatcgaaggacgctgtgcttacgcccttatggtgaataagaagaagtacaaccactactatcaggactttatctcgatcaaaaacaacatttccaagcggtcagagtga

SEQ ID NO: 14380 - RNA, 1077 nt, unidentified
  source 1..1077: mol_type = other RNA; note = synthetic construct
atgtttaagctgtgcctctgtggggtgatcatcatgctgaaacctctgggctcacccgcaactctcttgcggaggcgagagctgagtcacagagagcttaataggcacctaggctcccagccgggcctcatttcctcaattattgagaagggagtggccaggcactaccacaaaaaaaccatactttctggtaaccgcttcatgcgccgcagtcatgacttgcaaaaaatgagagagatactggaaccccaggatgacctcaaggagatacaacgggccatttctcgggtgcttagccgctacttcgtaccccatgagattgctcacgcttacgtcaagaacagaggaatcgtgacgaacgcaacaaggcacataggcgcacgatccatgttacacatcgatctggcagacttctttgggagtatcacccaggaggctgttttgaacggcctttaccatgtgttggaggacttttacgcgtccgacatcgagacaatcgcagagctatgctgttatgatggcttcttgccacaggggtcgcctgcttcccccattctgagcaatctggtgtgcttcccacttgacatggaattaagcgaactcgctagatcatttggctgcgctctgacccggtattcagatgatattgtctttagtacagccacacgcagcctgcctagcaagttagcgcgtgttagcgatagagaggccgcctatactgtcaaattaggtcagccgctgcgatccctatttgagctccacgggttcgaacttaatatgaagaagctgcgtttccagaggtggccaggtcctctgaaagtcactggcgttctcgtcggagaacgtctgcacgtgccaagggaattcaggcataatatcggagccgcactctctcagtggaagagacatgggattgtggtggccgcccggaatcatcccaaaggatctgccgaagcctttgcgggttctctcaaggggtgtatcgaccacgtaggacatgttgaaggcagagacagcacccattatcgacgcctgctgatcgacttggaaaccctgatcgctcgggatctgaactga

SEQ ID NO: 14381 - RNA, 1083 nt, unidentified
  source 1..1083: mol_type = other RNA; note = synthetic construct
atgcagtacaagtccttggaacgtcggctagggctggctactggtgccgtcagcaccgtcatgaacgccgacgctgggacaaggtacaccagattccccgtctcgcctaagcgcggcattatacgaaagccaggatggactcctaagaaacgcatgattctcgcaccttcaaaagacctaaaagcgatccagagggcaatcgctcgccatatcagctcaaagttcactgctcatcctatcgcccacgcttatgagaatggccggtccattttcgcgaatgcacgacaacacgtgggggccagatccattctgaaaatcgacctggtgaacttttttgggtccatcgggcgtcaatccattattgatgcactgagactgctgcttgacgatttcggcgacagagatattgaagtgatcgcagacctgtgttgttgcgatggctaccttccccaaggctctcccgccagtccggtattgagcaacctggtctgctaccccctggacgttgagctcgatcgactggcgaggcgccacggttgcaaggtgaccaggttcagtgacgacattaccttttctacatctgcagaggtttttccaccagtgctcgcaaggacgtggcggtctggattggcccatggagtggccttggaaagacccatctgtagcctgcttcagcagagaggattcgagattaatatagggaagctgatgttccggactagaccgatgcctctcaaaataaccggtctgatcgttacagatagtctcagcgtaccacgggccttttggcacaacctgcgcgcgagtcttcacaattgggaccgccgaggcttagatacgtgtgcccggacacatgctaacggatgcgttgtcgcctttgtgaattctttacgtagctccatcgagtatatcggccaggtgcagggacgggattgcaagaggtatcagagggctctcgccgcattcgaggaattacggtcaagggataaggaacccctctcagccgctatccagagaatcgctgccgctcgcaaagccaaaaaggccaaagacgagaacgtgataattccaggcaccggttga

SEQ ID NO: 14382 - RNA, 1071 nt, unidentified
  source 1..1071: mol_type = other RNA; note = synthetic construct
atgtttaaggccggggtcagcaacttcgatttgaagcaagtcctcggtgcaggcctagaaacagtggatgagatcattgctaacaaggaaaatcacatcgagcggatatcaatccctaagaagaacggcggaaaacggaatattatagcgcccgacccgcagctgaagtatatacagaagtctatctactggcgcgtcttccgaagatacaaagcagatccatctgcccatggcttcgtgttaaagaggggaatcgtgaccaatgcggactgtcatgttggagcaaaatgcctcggcaaaatagacatcaaggacttttttgatagcattagtatcgatcacttgaagaattgcctatttggtaacaaacatatctgcaggtactgtaaatactatgagaggatgttggatggcaggtgcaacccatcattataccacaacaagacacacaactttgactttaaatgtgaggaaatcaaggccgtgcatattcctgcttattgcgaagagacagggtacatctctctctttaatcgcattatcgagctgtgtacctttgaaggattcacggcacagggctttcccacttcccccatgcttgctaatatagtgatgcgcggattcgacaaatcgatgaaagaattctgtgcgacggaggggattgcttacaccagatatgccgatgatctggccttcagctcaaaaaaccttaccaagttcgagcttaagaagaagattaagcagaaagcctatcaactgctgtgggcatacggcttcgcccctaacaaaaaaaagactatctggaagagtagcgccggccgactcaaaatttgcggagttgtcgtgaatgtcaagaaatccgtacagcggaaggacgtacataagttccgtgctgaagtgcaccacgccaccgtgaaaaatgctgataagactacaaagggggacctgagaaaactgaaaggttgggcatcctttctgatgtccatcgacccagttaaggggaagaaatatatgaaccagctcctgaagttcgaggccgacaaattcagtattaagagcaaagggatttga

SEQ ID NO: 14383 - RNA, 918 nt, unidentified
  source 1..918: mol_type = other RNA; note = synthetic construct
atgaatatatacgaacttctcaataccacaagcaaggaagtgtcatcgattattctggagctcgaccagcactatctgagctacccaatcgccaaaagaaatcggaaaacgatgaggtggatcgatgctcctcagggcaagttaaaggagctacaggagacgttcctgcaccgctacttatataggttttccgctcatccctcttgcgtaggttttgtcaaaggaaagagtgtgcgcaccggagcagagcgccacatagggacagagcagctccttaacatggacctcaagaacttcttctccacgatcaaaatatataaggtggcgaagttgctgacatttctgacatcaagacactcaactatcactggaaaacaggtcacctttgttaatactgatgacaaggaaaagctcgcaaggctgctgacctataagaatacccttccgcaaggcgcccctagttctcctgccatcgccaacctgtgtgcctatcagatggatgtccaactgacagcattggccaagaacaatgggtgcatttatacccgttacgctgatgacctcactttcagcaccaagaagaccaaggacaagtttaacattatcggtatgatcccccagataagggagacaattgagaaaaatatgttctccgtgaactacaagaaaacacgggtgcagaaacaaaacaatcgaatgacagtaactggagtggtcgttaacaagaaactgtctaccccaaaatggtactggcgaaacttcagagcgaaactgcataacctggaaaaaagcggcgtgcccattactgaagaagagtaccaggaaatccgggggaccgctgagtggatcaaatccttgcatccagttagaggcgagaaatttttggaaactctaggcaagcttaatttaaccatttga

SEQ ID NO: 14384 - RNA, 915 nt, unidentified
  source 1..915: mol_type = other RNA; note = synthetic construct
atgaatatatacgatatgctagcgactgataaacagacacttaagacattgcagacagacatcgataaccagtacctctcttaccctattgccaagaagaagggaaaggcaatccgatggattgacgcacctcaacccgagctgaaaactttccaggaggcctttctgaacagctttctctacaagtttacggtacatccctgttgcgtggggttcgtacgtggcaagaacgtcgcttcaggggccaaacaacacctcggatcgaaacagctgctgaacatggacttccagaactttttcggtgctatccacattggcaaagtcagacagcttgtgaagttcctattctctcggtataagaagatcacagacaacgtcttcacctttaccagctatgacgtggaattgtttgcagcactgcttacgttcaagtccagactcccacagggggctccaacatcaccagcaatcagcaatctctgtaccttgcccctggacaaagaactggccgccctggctgctcaaagcgattgcatttacacgcggtatgcggatgacctgtccttttccactaagcaggagaaggccgtgttcgacgtgaaggatcttataaaaccggtgtctaagaagatcaccagagcccagttaactgtcaattataaaaaaacccgcgtgcagaggcctcataaccggatgaccgttaccggtgttgtggtgaatgagaaactgagtactccgaaatggtattggaggaattttcgagccaaactgcacaatttacagatgagtcaggttccagtcacccctgaagagtaccaagagattcgcggaacagctgaatggattaaaatgctccatcccatcaggggccagcaattcttaaacactataggcaagctgaatctgatgttgtga

SEQ ID NO: 14385 - RNA, 984 nt, unidentified
  source 1..984: mol_type = other RNA; note = synthetic construct
atgtttttacccttgactaccgatgagtttctggaccgaatactggtggtgaagaatcaatggaaacggtcaactatatactaccacgccaaagtgcagcactacaagaaacacgtgagagagaagaaaccggttaagaatatcctcgtcatgggagatgccccagtccccaagctccgagaaatcaatgaaccttgtcctgctttgaagtggatccaaggatatatactcaggatggtgcttgatcctgctactgaccagctgatgaaatgcgctcacgggtgtgtgccaggcagaagcaccgtgacgaatgctgcccctcacgtcaagtctcggtggaagatccatatggaccttaaagacttcttcccgactgttacggtacagagagtttacgggttgttccataaggtgtttaagtatggccccgacctgtcttggctgctggccaacctgacacagtatgagggtaaactgccacaaggcgcgcccacctcaccagctatcgctaaccacgtcgcaacacctatggatcgtcatctcgttaaactaatttccaaaatgggaggctactacacacgctatgtagacgatcttactttttcctttcctcgccagatgagtgacaaaaacaaaaccaggttcatcaagaccgttcgcgaaattgtggagagaaatggcttcgtcgtgaacgaggataaaacaagcattattgggcggggttcgaaaatgaccgtcaccggtattgtggtaaacgcaaagaccagcacaccccgttggtttaggcgcaacattcgggccgcactacatcagagggcgttaggggtaccatctgccgacaacgaccatgtgatcgggggcaagatcgcctatgtgaatatggtgtgccccgaacaggccaatgccttccacctgaagacatgccaggtcgatgattgcaagaagtgttacggactcgcaatgaagtccaagaacgcaagttga

SEQ ID NO: 14386 - RNA, 1554 nt, unidentified
  source 1..1554: mol_type = other RNA; note = synthetic construct
atgcctactgagaaaaagaagaaagtaaaccccctcgacgagtacacggatttcggcactatcttagtgttaagtgagcgccttgcacagtacctcagactgctgttcaagctggacaaggcttcatggaattttgccctggataaaatccgacaggggaaagcctatcgcgaatggagaaagtttaaaggacgggggaaggggtaccgctactttgctgctccgtgtgccgagctcaagacagttcagagaagcatcaaggcgcagttcctcgatcagattccgatacactttagccggtatggctgccaggggggaactggcatcgttgagcatgcggccgcccatatgggcaacaaggtagcattcggtgtcgatataatcaacgcataccccaccgtacttcgctcacgcattcggaagtgtttgcagaagccctttcggtttatgttgagacaattcggagatgtcacctggctggaggacgatgtgaaaaatatgcttgaggctgttgtggacctgctctgcctgcacgaccgtttgcctcagggccctccaacatcacctcgtattctcggcattgtgtgctacaagatggataccgccattttcagttacttacacgagtcctccagcccccttcagggcttcaacatgacatcttggtttgacgacataaccgtcagctccgataaagagattcccgaagagatgcgggccaaaattctcgccctgattaaggaacacggtttcatcccccatactaggcctgacaagaccaagtactattcacctgaaacgggggaggtgccaattgtaacagggatcgtgatatgtccagatggtcgtctgactatggctccaagaaaagttaaccagctaagggcagcttttaataactggctcaaaattgaagtctgggacgaacacatcctgggcaaggtgaatggcactttgggagcagtccgacaactgtatccagaaaagctgccaagcaaactgagggtgcttgtggggaagattgaagacaggcttcacgccgggaaggttgcaaaatctctccagtatttggacaatgcactgctaccgtcgggactgcaggatcttgcgaaacagcttagcatggtcgtcatcgacggtcaaggagacgtgagctctcaactcctgggcgacaacctactcttcgtggatggcgccgcgaggaaatcttatcaggccgggatcggagccgtgctgataaaggaccgaaccgaagtctccacaatcagtcagttgatcggaaaagcaaccagtaatcaggccgagtatcaagctatcatcgtgggtctgacagctgctaaagagctaggcatcgcggaattagattgcttcaccgattctatgctggtagtgaatcagctgaacggaaagttcgctgtgtcgaagccccatttacggacgctggtggcccaagtcaaggcattggtgaaagaaattggtaccgttaggtttcatcacgttcctagagagctcaatacatccgcccattccctggcccacatggctctgaaatga

SEQ ID NO: 14387 - RNA, 1125 nt, unidentified
  source 1..1125: mol_type = other RNA; note = synthetic construct
atggccaagaggggcaagaggaagaacaaaaagcccttcgtgtttaaagacttcgaaactgtcttagcacttcccgagcgactggccgaattcttacgcctccttctgaagttggataaagctacctggtccttcgccctggataagatcagacaaggcgccgcataccgcgaatggagcaagagtaaaggtccaggaaaagggcggagagactttgctgctccatgtgcagaactgaaggccgtgcagcgggctatcaaacagcagatgctggatgtaatccccattcactttaccaggtacgggtgttctacgggggttggaatcaaggagaacgcagccgcacatgtcgtccccggcgtatccgtgtgtgtgaaggagttcgacattatgaatgcctttcccaccgtgttgcggtcccgcatccggaaagtcctccagaaaccattccggtttctactggaccaatttgccggtatggagtttggagatgatgatgtgaaactgatgcttgagtccatagtggatttggtttgcctgcatgacaggcttccccagggaccgcctaccagtcctaggctctttggcatcgtggcgtatcgcctggactgcgcgttgttccgtttcctccacgaaaactctacagagttccaaagctacaaaatgaccagctggtttgacgatgtgtccatttcttcgcgtgacgaaattccagaagaggttggggtgaaggccgcaaaaataatagaagagcatgggttcactgcccaccaccgaaaagacaagtctaaatactattcacctgctacgggaactgttccagttattacaggcctcgtcctatgcgcggatggccacctcacaatgactccgaacaaggtgaatcagttaagagcagccctgcataaatggagcggagagaagagttgggacgaggccaccctggggcagatcaatggcacactcggttgcattaaacaggtatatggcgataagcctcctagcaaactgagaaagtcagtgcgagagattgaagctaggctggctatgatgaagatcgagaagctgcaggctgacgtcgctcgcgccagagtcatgcctaagaagaagtcaaagaagaaatga

SEQ ID NO: 14388 - RNA, 1365 nt, unidentified
  source 1..1365: mol_type = other RNA; note = synthetic construct
atgatgggcaccagtaggttcatggtgtctctgccctgtataatggcttctagcttcaaacgcgagatgggcaagatggcgaagaccaagcgccgaaaaaagcggaagagggcagaatggacatgggtcgactttcgggtgatccttgatctgcccgagaggttaagtagatatctgcgtgaactcctgcatttggataagccttcctgggactttgcgctcgaaaggatccggcgctacaaacaatggcagaatgaaaaaaaggagaagccagatctcggtcgtcttccccgaactcaagtagcttactttgaatggtcgaaaagtaaaggaaggggcaaagggcggagatatttcgctgcaccatgcgcggagctgaagctggtgcagaaagcagtgctgaataggctcctggcgtccatcccagtccacttctgtagacatggcaatcagcctggatcctcgattctgagcaacgccgcccgccatatgggcttcgccaaaagcgtgttttccatagacattgtaaatgcctttccgacagttttcaggagcagggtcttcgccaacttgaaaaagcccttcaagtttgtgttgagacagttcgccggagtggaattttctgaagacgacatcaagcagatgctagaggttctttgtgatctgatctgcctacacgaccgactcccacagggtccaccgacctcaccccgtattctggatattgtctgtgcaaaaatggatcaggagttgtacgctctccttgagaagaattccacccctttccaatcctatagaatcactgcttgggccgatgatattaccatctcttgcgacggggagatacccgaggagttgagagaacagtgccttaaggttattaaagacaacgggtttatcccgcacacccgggaggataaaacaaagtactacagccccgagactggagaggttccagtagtcactggcctggtgctgacctctgacgggcggatgacgatggcccctcgcaaggtgaaccaatttcgggccacactccaccaagccctaaagcgaagtgagtgggacgcacagatcagaggtcagattgctggtacgatggggtacatcagacagatatatcctgacaaactgcctagcgcactgcgcgaattagtgcctcagacagaggctcggatgcaggaagagtgcaagaaggcattacagctgaacggagaggccactcctactgtgcccccaaactcactgcctaaaaaaaagggcaaggccaagactaaacccgctaagacaccaaaatcccgcacctcagatgaggccgaagaatcttcagctaccgagacagtcctctgtgaaatgcagagctga

SEQ ID NO: 14389 - RNA, 1314 nt, unidentified
  source 1..1314: mol_type = other RNA; note = synthetic construct
atggcgaagaaagccaagaagcccagagggaccgctccagaagaacaaaaaaaaagaagaagacgacggaaagaatggacctttacgaactttcagaacgtgcttgccttgcccgagaggctggccacctacttgaggctgctgctgcatctggacaagacatcctgggacttttgcctggataaactcaggcagcatgtaaaatgggaagcggaggttgaggacaagcgacctaaagtccaaatcaatgtgaaaggcagagaacgcacctcaagatccggacccgcttatctggcatggtctaagtccaaagggcgcggcaaaggccggcggtattttgcagccccctgtgatgaactggggagagtacagaaatctatactgcacaggtttatttctcaagtcttcgtgcacttcgccaggtatggcggacaggtgggcagcagcattatggccaacgccggacaccatgctggtttcgccaagtcggtgtttagtctagatatagtcaatgcatacccaaccgtgtatcggtcccgtgtgcgcgctactctgcggaagccgtttgagtttgctctacggcaattcaagggagtcacattcagtgaggaagatgtgttgaaaatgctcgactccatcaccgatcttatcgtcttcaaggaccgcttaccccaggggccaccaacatccccccgtgtttttgacattgtgtgcggtaaaatggatcaggagatttttcagtggctggagtctaatgccacgcccttccagggataccgctacagtgcatggaccgacaatctgaccataagttcagatggagaaatcccactcgaggttcgacagaaggtgattgaaatcgtccgcgagaatggcttcttcccgcacatgcgagaagataagatgaagtacttcagcccagagacaggcgagcgccccatagtgactgggctcgtggtgttacctgacggcaggattactatggcacctcggaaagtgaaccagcttagagctaggcttcaccagttgatgcttcgtaaagcgtgggacaaggaggctatgatgctcatcgacgggacaatcggtttcgtgagggagatttaccctaagaacctgcctagcaagctccgagacgtggttttagccgtagaggcacggagagcttcaatgagggtcccagtagtgcatgatgagagcatcgaggatgaggatgccatcatgctcgatgaagaccctgaaacaaaggttccgtctcctagcaagaagaaggacgagggtcctactgagactgtctcagaagttgtcctgatgtga

SEQ ID NO: 14390 - RNA, 1311 nt, unidentified
  source 1..1311: mol_type = other RNA; note = synthetic construct
atggctgagaagccagaaaagcgtcgccagaggagacggaaggagtggaaatacgataactttgccgcagtgctggccttgccagaaaggctcgcccatttcctccggctatggctgcacttagacaagagcacttgggacttttgtttggataaactcagacagcatagagcatgggacgagcaggtggcccagtttagggctcaagaggggaagaagagaaagaagggggaggccgaggtgccaaaacctccgaggtgtggccccgcttacctggaatggtccaaatcgaaagggcgggggaaaggtaggagatactttgccgcgccctgtgaggaactgaaggtggtacagaaagccattaacaatcgcattctggcacacatcacggtgcactttgctcggcatggcggccaaataggctcaagcattcttacaaatgccggacatcacgctggttttgcgaaaaccgtgtttagcctagatatagtgaatgctttccctagcgtatacaggtccagggttaaagcggtcctgggcaagcccatcagattcggattgcagcagttcgcgggtgtggccttctcaccagaggatgaggaagccatatgcgcaagtatcgcggacctcctggtcttcaaggaacgcttgccccaagggcctcctacctcacctagagtctttgacatttgctgcggtaaactggaccaggagatcttcgctctgctgcagggacactccaccccattccaatcttatcgatataccgcatggacagacaatctgaccttctcatctgatggcgagattcctgaacccgtgcgggagcagctggtagaactggttcgcaaaaacgggttcttccctcacacacgaccggataagatgcgttactattcccgcgaaactggagaggttcccattgtgacaggtttagtcctgggcgccgaaggaatgctgaccatggccccgcgaaaggttaaccagcttcgggcaaggctccatcgctttgagcgcctcgccaactgggacgatcagatccaaggagaggtggcagggactcttggctacatccgacaggtctatccaaagcgtttaccaagtaaacttcgggatgtcgtagctgccatcgacagcagattggcagccaataaggctgtgacgactgaggtggccactgctccaacacctgcaccctctacccggcctaagacaagtaaggcccccggaaaaagcaagggcaaagctcgagctaaatccgcaggcaagcccaaggtcaaggaggaacttctcgccgaagcagtttcttga

SEQ ID NO: 14391 - RNA, 1239 nt, unidentified
  source 1..1239: mol_type = other RNA; note = synthetic construct
atggcaaaagggaagaaggtaaagaaacagaaacttcaaaagaccgacgtgaaagacttcgaggccatcctccaaattcctgaacgtctcgcacagctgctgcgcttactctttcatttgagcaaacctgagtgggatttctgcgttgccaagatcagacagaaggaagcgtatagagaatggagagagagcaaagggcctggaaagggtttccgacagttcggcgcgccgtgtgctgagctgaagctggtgcagaagcggatcctgcagaacttcctggctaacgtcacagcccactttattcgtcacggtaatcagccaggttcctccatgatgaccaacgtgcaacaccatgccggattcgccaaggccgtgtttggcatagacctggtgaacgcattcccctctgtatttcgctctaggattcgggggaacctcagagtgccactggagaggaaaatttctgagtttggcgaagaagtgaataaatccctctccgatgaggataagaagattatgcttgaggccgttgtagatttcttgtgtttacatgataggctgccacaaggccctcccacgtcacctcgagtcctagatatcgtttgctttgcccttgaccggtcgttggccggaattgccgctaaacacagcaccccctttcagcagtatcggctgacagcgtacgccgacaatttcactctcagttccaatgacgaaatccctgaggaagttaagactgaggttctagaagaaataaagaagcacggctttatcgcacacacccgaccagataaaactgaatactactcaccttttacgggaaaagtcccagtggtgaccggcatagtgcttcccacaaccgccgacgggcatatgaccatggcaccacgcaaagtcaatcaactgcgcgcacgcttacatcagtacgctgagaaatcaacatgcacagatgaggaacggggtgtggtgatgggcactatcggatatattaggcaggtctaccccaagaaggtgccaagcaaactgcgagctctggtggagcagattgagacgagggccagaatagagagattgcctgctcctgctgtcccgatcgaagctgttccgaagaaggtaggaacagacatcgatctttctgtcatccccagtgctgacaccgcaaaacccaaaaggaaaaagccaactcccaagaaaagtaagctcactaaggactattgtggggagagcctgcccttctga

SEQ ID NO: 14392 - RNA, 1281 nt, unidentified
  source 1..1281: mol_type = other RNA; note = synthetic construct
atgaaaatcgctaaactctgcaggtggctgtggctcgtgaatgggttacaactcaacaagaagcgaaggccaggagtagctaagaaaggaaagaataagcggggcaaaaggcagaaaatagtgggcgacgacttcagggtagtcctggacgtgcctgagcggcttgtgctgttgctgctccagtttctgcacctaactagagcgaactggtccttcttgatggatcgcatccgccagtacaaaactgatgggaccccagtctacaccgagtggtctaagagtaaagggcggaacaagggccggagatatttcgctgccccttgcgacgaactgaagctggtgcaaaaggccattttaaatcggttcctgctttccgtcccggttcatttcatccggcacggtggccagcgaggttcctcgatcctcactaacgctgagacgcatgcaggctttgctaagtccatgttcgtcgtggatataattaatgcctttcccacggtattccgatcacgcattaaggctaatctacgcagggcatggttagaccactgtcgaatgtttgagggagtcgagttgtctgaagcggacaaggagatgatgctcgaggccattgttgacctagtcgcctggagagacagactcccacagggacctcccaccagccctcgtgtgctggacatagtctgcctgcgcatggatgagcagctgtatgaactgttctatagtcattctaccccctttcaatcgtaccggtccacagcctatgtggatgatctgactttcagctgtaatgcagattcaatccccgaagagttgagaagtgaagccctggaaatcgttagacagaacgggtttttaccacacacaagggaagacaaaacagtctactatagcccagagactggaagagttcccgtggcacttggcctggtgatcggtcgggacgggcgaatcaccatggcaccttacaaagtgaaccagcttcgctctaggatttacacccttttgaccaaaaagggcgagctggatgatgtaagtcgtggtcaactccagggcaccattggctttattcgtcaggtgtaccccagaaagcttcccgccaagctccgccagatcgtggaacaggcggagtggaggctgtctgccgaaaaatcaggggccacggttacaatagttgtggaggcactgccagagctggagactcctacaagcgaaagcagctccgaaggagtgacatctagcccgacacaagtgaaagaggctatggaattgtcagcctga

SEQ ID NO: 14393 - RNA, 1224 nt, unidentified
  source 1..1224: mol_type = other RNA; note = synthetic construct
atggccaaaaagggtaagaaccggagagggaagaggcagaaaatcgttggcaatgacttcagagtcgtgctggatctgcccgagcgtttggtcctcctgctgcttcaattccttcacgtgtcacgagctgactggacctttctcatggaccgcatacgacaacataaaaccgacggtacgccgatatacacagaatggtcagagtccaagggacggggtcgcggtaggaggtatttcgcagcaccttgtgaagaactgaaactggtgcagagagcaatcttgcaccgcttcctgtctactgtgcaggtgcactttgtgcgccatggcaaccaaccgggaagcagtatcctcacaagcgctgagacacatgccggggcaaaaagtatgtttgccgttgacatcgtgaacgccttcccatcagtcttccggtcacgcattgaagcaaatctgaaagggccctgggaacacgcctgcaggatgttccagggcgtggaactgtccgaggctgacaaggagatgatgctggagacaattgtggacttagtagcgtggcgagatagattaccccaaggaccacctacctccccgcgcatcctggatatcgtgtgtttgaggatggataaacagctgtacgagctctttatttctaatgggaccgtgcagagttatcgttctacggcttatgtggacgaccttacctttagctgcaatacagacagcatacctgaggagttgagagaaaaggccctggaaattatccggaagaacggctttattccccacaagcgtgccgataagactgtttattacagcccagaaaccgggcgagtgccaatagttttaggactggtcatctgccatggcgggaggattactatgacgccccggaaagtcaaccagctacgggccaggttacacactctcttgacaaaggagggagaacttgacgatgtatcgagaggccagctccaaggcacaatcggattcattagacaggtgtacccaaagaaactccccgctaagctgtgtcagattgttgagcaggtcgaaaggcggctaaccgctgagaagagcggcgccaccgttactatcgtaatcgaggcacttcctgagctggaaacttctaatgccgatcccgagctcaaagatgccgctgtgcctcagcaggatgtcggcgagtccatggtcagtccagcttccgtacaggaggtggcggcgccttga

SEQ ID NO: 14394 - RNA, 1245 nt, unidentified
  source 1..1245: mol_type = other RNA; note = synthetic construct
atggcaacctcaactcggaggcggcgaaggcacacacctaaggagtgggtgtataaagatttcgagtccgtgttggagttacccgagcgcctggcacgaattctgagactgctactgcacctctccacccaggagtgggacttttgtcttgacaaactgaggcagaaggccgcttacagggaatgggccgaaagcaaagggccaggtcgtggcgttcgacgatacgcagctccctgtgatgaactgaagagcgtccaacggaaaatcttgaatcgctttctcatctccattcccgtgcatttctgcagacatggaaatcaaagagggtgttcagtgaaaacaaacgctgagcatcatgctggaaacgaaagagcgttcagcattgacatagtcaatgccttcccatccgtgtatagatcacgcatacgggccaatctgcgtaaacccttcacctttgctctcaaacagtttagcggtcaaacatttgaggccgaggagattaaacagatgctggaatccctggtagatcttgtctgccttcacgataggttgccacagggacctcccacgtcgccgagaatcctcgacatcgtgtgctgcaagatggaccaggacatttggaaattaatctctgagaacagtaccccgttacaggagtacaggataactgtctggtgtgacgatttgacaatcagttttgaagaagaaatccctggtgagcttcggaagaggatactcgcagttatgaagaagaatggctttttcccccacgagcggaaagataagaccaagtacttcacccctaaaaccggcgccgtgccggttatcacaggaatcgttctggcacccgatggcaggatcaccctagccccaaataaactcaaccagttccgcgcgaggatcaacaagctgctcgccgtgattaaagcagaacctaccaagcaagtctatggcgaaatagctgggacgattgggtatctgcgtcacatttactctgacaagttgccaagcaaggtacgggctattacagagaaggcggagactgagctgaagaccatcaagttcaacgaacttgcaggggaactgggcaagaaaccacggcgacgcaaaaagacgactgccgtgactcccgagccacagacttcagaaacttctgccgagacacagattgccaccgaggaaccacctcgcagacgcagtagaaagaaaaaggacacagctgatgagtctatcccttttaagtga

SEQ ID NO: 14395 - RNA, 1371 nt, unidentified
  source 1..1371: mol_type = other RNA; note = synthetic construct
atgcctcgcaaaaagacacggaaaaagtctaggaacattgcacgcggcaataacttcgtgaccgttctatccatgaacgatgatcgccttgccaagaccatccgccagattatcagttttcaaaaaggagactgggatctactaatggacgtactgcagaattcctttgtgtatcgagtggagcgaatctctaaaggcatcgggaagcctcccagaattgtacacgctcctaacggcctcctgaagaaggttcagagaaagatcctcaaccggtttctgagtgaaatccccactcactctgctaggcatggtggcggacaaaaaggcacctcaaataagactaatgcgttagaacaccaagacaacgcctatgcattctccacggacatcatgaatgccttcccgagtattctgaggtctagggtcagggcttgcctcaaaccacacttgaagcgagtgctctaccagtttcggcctctcgtctttgagtttgaggagaagcgtgacccacgggagaaaccgacttgtgatggggatattgtcctcgaggggttgattgacctgctggtgttcgatgacagacttccacagggacctccctcctcaccaagactgttggatatcgtgtcgtataaaatggactgcgatctttggcgccttgcccaggagtccagcaacttaggtgacgagtacgtctatacagcttacgtggatgacctgagcttcagcagtgcagttcccatacccgaagaagtacagcagaagatgttgaccatagtgcgggacaacgggttccacccccaccacagccccgagaaaactaagtaccatggccctgataccggcagccatccagtgataacaggcatcctgattagagatggtatgatgcacctgcctactcggaaacagaatcagttgagagcacgtctgcacaaccttaatgtggctaaggaagcctggagcgacaacgagcgtggtgaggcagctggactcttagggtttatccgccaaatataccccctggattcccataggaaactgccgtctaagctcaaagaccaggttctgttctcagaaaatcgactgcagcagagaaaggtcgtggtaagcgaaacaccattcggcattccagtggccgaggaagacgtcataacaaaggtgtgtcagaataacccatcaatcagcgattttaatgcgctggccgtctcaacgagagttggatggacttcccatagtggaatccccttcacggggaccattaccgaacggttccctgacaagcctcatctggcccaggttacctacctttctaaggggggcaaaaggtgtggaacacgcctgaaatgccaaaggttggccgtgctctga

SEQ ID NO: 14396 - RNA, 1263 nt, unidentified
  source 1..1263: mol_type = other RNA; note = synthetic construct
atggccaaaaggaaacgcggtggagccgctagtgcgggagatgctcccactgcaactctggtggcggacgacgatgtggcccagaccttccagaaaatcttcgctgccttgagtgaaccggctatgacatttctttcgcaatggctgggcatccctcgcaacgccacagatcgaggcgttggattggcccgaccatatacattggcagatgcggctgctatcctcgagaacggtactccatataggcgctactttagacccaaatccgggggaggcgtgcggcgtataagcgaacctgctgcttcagtgaagcatgtgcaacgacgtctgctgcacgtggtcttcccgagcatcccggtacaccatgctagctttgccgggctgaggacccggtctgccattgaggcaatagagtggcacgctgcccaggggaagccttttttcaaagtcgacctaaagaacgcataccccagcgtgtcccggaccaggctgaccaaggtgctacggggccccttgcaggagtatcttgctcgcgccgccccccatcttgtcgcagaagagtacgaggccctcatcaattttgtcatttccatttgcctcgatgcgggcggattagcacagggtgccccaacatctctccacctgatgaatgcagcaagattcgaactggactgtgccctcgccgcctatctcaggagtctgccagggagctacacgtacacagcctacgtcgatgacttaattatctctagaggggacgccacggagattcccgagtacgtccgagagagaattgttcggatcgtgcttgcccatggtttcctggtaaatcgctccagacgcaaaagaaaggtggactattggcctgctggaactggagcaaggaggccagttgtgctggggctagttccacaccgggacggtagggttaccatttccgcaaagaaccgaaagcgcttcagggctgccctgcaccacgcactgtcttcccctgaaagctcagatgcgcacagagcccaagtagccggcgtgatgggctacctgcatatggtatatggcgacgaccgcttaccaagtgagttgcgggtgctgtacgctcagtgtagagaaagatttgggcggccaaagactcctgggggcgcttatcctgacatcgattgcctccttgccgagcagcaccccggagaaggcaaagcagcagacccccattcagaagtcgatgatgcgcgtgcctcaggcaagccccctaccgattctgcttga

SEQ ID NO: 14397 - RNA, 1212 nt, unidentified
  source 1..1212: mol_type = other RNA; note = synthetic construct
atggctgagcagagcaggttaccaatctctttcctcctggatgccaggctggaggaggtgctatgtcaaatactgaaaattgatcccgccgaatggagagcaaccaccgccctctgggcctctggcaatgcgtggacgatccacaaaataccgaaaaagaaggggcacagaaccattcatgcacccagcgacccactgaagaaggttcttcgggcgctccttactcagtttatccaaggcattcctgtccatctcgctgttcatggggctcaccccgggacatccattgtgaccaatgcccgcgctcatgttggaggaaaagcattctacctgctggacctgaaggacgcattccctaccgtgaacagaaaacgttgctcagcgatattcggacccactttcactggctatatcacagtcgttacgggcttgccagaacaggacggtaagaggcttgctgagacatttgttgatcttttgatcgtagacgacgttctgccgcagggctttcctacttcacctgctgtcttgaacgtgctcctaggccaggtcgacaggaacatatcgcagctcctgcgatcagcatctgccacagagggggtggtgtacaaatacactcggtttgtggatgacttaacaatttcatcctccgacgaggtgatccccaagaagctgagacagaaaatcagacaggcggtccgaagcgatggatggactattcagggtaccaaagtcagttattttggggacggggccgaaggtgacgaggaaagaaccaccaagtatccagaagtaacaggaattatccccaaccaggatggtcggctgacgattccacggccacgactcaataagttccgcgccatcctccacaatctactggaggtagccgataaacgccagagtggagatgaggaggcactgaaggcagtgaaagcccaaatggagaaagatgtggtggcctttcggaagcgcgggatcagtttggacagcaacttgagccctgacaaattctatgctagggagtggcccctgaccacaagggaacaccgccttttagtgggcatcgtgggcttcgtgagcatggtatacgatcaaaagctgccttctagtattcgtgaactgtacatcaaggccaagactcagtttcggattggcacccgtgatatctcccaaggacacgcttactccttcgtcaaggaaacagaatga

SEQ ID NO: 14398 - RNA, 1194 nt, unidentified
  source 1..1194: mol_type = other RNA; note = synthetic construct
atgccaagttcttttttactcgatgctagcctagaagagactctgtgccgtgtgctgaagatcgatcctgccgagtggagagccacaaaagctctctgggagagtggcacggcatggacaatccatcacatccccaagaaaaatggtgtgcgaataatacacgccccgtcggaccctctgaagctggtcctaaggtccgttctgaaactgtttctgcagtgtattcctgtgcatatggctgtccatggagcccatccagggacatctatcgtgacaaacgcacgcgcgcatgtgggggataaggccttctacttcctcgacctcaaggatgcgttcccttctaccaatcgaaagcgttgtgcttctgtcctgggacctcgccttgccacacaccttgcagatgcaaccgatttatcagaaaaagattccaagcgccttgccgagactttaattgaccttctaatcgttgacgacgttttgccacagggctttcccacttcccccgctgttctcaatgtcgtgctcggagcagtggacagagtgctctcacagctcctgagggccgagagcgagaaggaaggcgtagtgtaccgatacactaggttcgtggacgatttgacaatttcaaccgatgctccagagattagcaagaagttgaggcaaagcattaggcgggcaataacccacgatggctggaccattcaggggacgaaggtgcactatttcggggatgcggaagagggggacgaggaacgcaccacgagaaaccctgaagtcaccggaatcatacccaatcccgatggtcggctgaccatcccaaggccaagacttaataagtttagagcaatcctccacgacttgctgactgccagcacacaacgccttgaaggtgacgccgaggccttgggcaaactgcaggctcagtttgacctgttccgggagctgtgcaaaaaacgcaaggtctggatccagccgaacttgaccttacaggagtggtgtggcaacgactggccgctgtcccctcgtgaacggcaaattatcgtcggcattgtgggattcgtaggtatggtatacgaccagcaactgcccagtattatcagaaaaccctataacgaagccaaagttcggtttggcatcggcctgcgggacatggctggaatcaatgggtataacctggacactgagatttgctga

SEQ ID NO: 14399 - RNA, 1026 nt, unidentified
  source 1..1026: mol_type = other RNA; note = synthetic construct
atgtgtgtgaattcttcaacagcggcccggtttgctcagcaagaagtatttatgacagacccttctgcggctcctgcatccttccacaaactgacgcccatgattgaacgcactttcgtcgagttgattagggaaactgaggccgtctggagttggtgccaccagctgtataccgatggggtaccttgggaaatgagacggatcccaaagaaaaagggatttcgcactattcatgccccaaaggatcctctcatggccattagcagagggatattgcatcatgtgctcagacgcctcccagtgcatagatccgtgcacgggtccgagccaaggtccagtgtgatcaccaatgcacgagtccacgctggcttcgcaaaatctgtctacaacttagacctggagaacgcctttcccagcaccaatcgtaagcgtctggttgcaaacctgagcccgaaaatgctggctcttctgctggactcgaccgatctttccgaggaggaggcatcagtgcttgtggagttgttaatcgatctgatgctggtagacgacatcttgccccaaggcttcccaacaagcccagctgtgctgaatattgtattgctcccggtggacagggagattagccggtacctccgacaggtcggtgaagaactaggttgcgagctgcggtatacccggtacgttgacgatatcaccatcagcagtgatggcgacagaatccccaaacccgtcaggaatcagatacgcaagatcatccgtcacaacggatggaagattaaccagacaaagctgatgtaccacggggatgccgagcctggagatgacgaacgctctactaaaatgcctatggttacaggcctagtgatacatgacgatggacggctgacggtcccccgatggaagttaagaaagtggagggccctgatgcacgagctccttcaggccgaagatgtgtcacaagaccagagggataccctagtgggtgttgtgtcattccttactatggtttatgacggcgacctctga

SEQ ID NO: 14400 - RNA, 1188 nt, unidentified
  source 1..1188: mol_type = other RNA; note = synthetic construct
atggccttgaagataacctgcccccagtgtactgcagaatttttcgttgtggaggccttcagcggtagtaagattgtgtgcccccagtgcacatccgctattattctagcattaaaaactcagcatccttcgacacatatctctggtcctaaagcgatcctgccttctcagatgctgaacattaaggaggaggcaatccgtcacttagagatctggctggacgttccgtctgtttctatcaagaatgccctgtcgatgatagaacaagataaagcttacgaggtgtggaagattcccaaaggcgaaagcaacacgttccgagaaatcgcggctccagccgacgtcctgaagcacatacagcgacggattctggacagactcctgtatcggatcccagtcagtaacgcctcccacggcttcattcagggtaggtccatcgtcaccaatgccagcttccacctcaagacagccggggcagtgctgaattttgatctaaaggatgctttcccctcagtagatgcccagcgcatcaagcatttgcttgtacggtacctgaagattcccctcaagcacttggggggaaatattccccacgaagccctggaccaagccattgagatgctggtcaaatttaccacctataaaggagctctccctcaagggggcccagcctcaggatatctgcttaacatagcatgtatttccctggataaaactatctactcacttctccagtcttatggcaattcctaccgctacaccagatacgctgacgatatcaccatctcaagcccaatgccctttccccagggccttcaggaggccattgagacagcgattcataacagtggtttccagatcaatcctaagaaggtcaggtacgctgtgaggtcccaaggccagagactcgaggtgactgggttgatcctggaaaaagacaaagtgcgtattccgagccagaaaatcgaaatcttccgggcaattatccaccaagctgggagtcttgagacgcagaacctccaacctgagaaaagattggagatacagagcatcattgcctttatcaaaatggtgtatggcaagatcccataccgcatatggggaccatacaaggcttacatggaaaagcatggaatatttatgcctaggaaaacatctaaggcatatctgagcttatatccacactga

SEQ ID NO: 14401 - RNA, 1212 nt, unidentified
  source 1..1212: mol_type = other RNA; note = synthetic construct
atggcggttgaaatccgctgcccggaatgtggcgcagccttccaggcagaggatgtatttcccggcagtcgagtgagttgtcctagctgcgaggcgattctcattctggacgttgagaaacaacggctgtccagaaaatctattgtgccaccagtgcccgggcccaaaatatacaagccagaggaccaggattctctcaaacgggctgcgattaatcatctgagcaattggctggatattccagccacacagataaatgaggctctcgcatcacttcagaaaggagagggttacaacgactggaagatccccaagggtaacgaatattccttcagagagattagcgcccccattcaaatcctcaaagacatccagcggcgggtgctggatagattgctgtacaggattccagtgtcaaacgccgcacatggctttattaacggaagaagcatcgtgaccaacgcttcttatcatcttgagacagctcagtccatcctgaatattgatttaaaggatgctttccctagcgtgaagaaggaaagggttaaacacttgttcgtccgctatatcaaaatccctctgaaacacctgggtgagcagatcgatcatggcgttctaaataaagtagtggacatcctggtagaattgaccacgcacaatgggggcttgcctcaaggaggaccctgctccggatatctgttgaatgtcgcctgtatcaccctggataaaagcatctataggctgttacagactcacagtactcaatacatccagtaccgctatacacgttacgccgacgacatcacaatatccgccaatgccccaatctccaatatgctgaaatcggagattcagaaggctatactcaataacggctatcagattaaccctaagaagatacactacgcagaacgaaagagggggcagaagcttgaggtcacggggcttatcatcgaaaagaacaaagtccggatccccgcatcaaggctggacaactttagagccaacattcaccaggcctctctcatgaacaccgctgacctcacccctgaaaagaagctagaggtccagtcaataattgcctttgctaagatggtgtacggaaaggtgccacaccgtctctggggcccgtacaacacttatctagaaaagcatgggcttactcaccctttcgggcgcaagggcttacaatgggaccagtacccctcttga

SEQ ID NO: 14402 - RNA, 1197 nt, unidentified
  source 1..1197: mol_type = other RNA; note = synthetic construct
atgtcgattaaggtacagtgccctcagtgtaatagtgggtggaacgtgacagaagctttccccggctctatggttcactgcgccaattgtggctgcgcagtgctgctcgccatcactccaacctatacatcccagagattccttactccagcacctcaagtgaccgggccttcacagcaggaagtcctcaaagagcaggccgtggggcacttagaggcctggctggacgtgtctgcggaacagatacaacaagcactggaaagcattcgtctggggacagcttacgacatatggaaaatccccaaaggcgatagcggcttctttagggagataacctccccttgcgatgtgctgaagatgattcagagacgcatccttgatcggttactgtaccgaatcccgtccagcaatgcagcgcatggttttattccctccaggtctatcgtgaccaatgcatcctatcaccttaaaacagccggagcggtacttaatctggatatcaaggatgcatttccaagtattacatcgcagcgggtgaagcatttgtacgtgaggtatttgaagatgccgctacaacaccttggggtggctgtcccacatgccgtgttggactatgctatcgccttattggttgagctgaccacctacaacaaccaactcccgcagggcggtccctgttcaggatacctgctgaacctcgcctgtctgcgtctggacaaagagatttttcgactgctctccacatacggcgcctcttacaagtacacgcgctacgctgacgatattaccattagcgccccaatgccctttccagaggatctcagcagcaatctaatgaaagtcatcctgcacgccggatttcaggtcaataacaagaaagtccactatgctatccgggataagggacagcggttggaagtcacgggactcatcttggagaaaaataaggttaggatccccaacgaaaagctggagaagttcagaactattatctaccaagctagtctactcgacactgagaacctcacttgcgaaaaaagactggagatccagtctattatcgctttcgtgaagatggtttatgactcagtacctttccgcctctggaagccctaccagatatatctggacaagcataacatacctctgtcaaaaggtagtcagcacctgagccttgacttatatcctcattattga

SEQ ID NO: 14403 - RNA, 1290 nt, unidentified
  source 1..1290: mol_type = other RNA; note = synthetic construct
atggccactaccgtcaattgccctgggtgcgccagggagatttcaatcggccgcgcttttactggagagaggcttgagtgccccgactgccagacgatactgctgctgaaagtgaccgctgctccgagtctggacagaccgcagacaatattaccgcctccgccacgcttcgctcatccacctgccccaaaagatgaggcggagatagatcgcctcgccagagctcatttagcaagctggcttgatctgtctgctcgcgaactgggcgctgccctgtctctcgtcgagaatggccagggctacgacacctggcagattcccaaggccggcccatccttcagaacaataagcgcgcccaaggaagaactgaaacgggtgcagcgtaggattctggatagaatcctgtataggattcccgtatcgaacgcctcccacggatttgttcctgggcgttccatcgttacaggcgcccgggtgcacctggaggatgcaaaggaggtgtataatttggacctgaaggatgcctttcccagcgtcgacgccacacgagtgaagcatgtgtttgttcggtgggccaaaatccccttgaaacaccttggtccacatgttgaacacgccgtggtcgaccgagtagttgaactcctggtaagattggtcacccacgagggcaaactaccccagggtgggcctacgtctggctgtcttctgaacttggcttgtctgaagctggacaagtacgtctacagattcctcgggcggtatcccggggatttgcggtttacaaggtacgcagacgacctgactgtaagctcacgcgacaccatccccgaggaggtgcgacagggtctacaggccgtgattcgggactgtgggttcagagtgaacccccagaagatcaggtatctgagtaaggctaggaatcaaaacctggaagtgaccggtcttatcctagaaaaaggccaagtgaggatcccacccgcaactctcgatcgttaccgcgctattctccaccaagccgcgactgcccatgagttacccgatgaaaagcgcctcgaggtgcaatccatcttagcgttcgtgaagatggtttaccccgcactcccaggggctattcggaaaccctttgaggcttacgcagccaaacacgtcggacggcctccaggacctcgaaaggcattcggactcgatctttatcgaggcgcaagaccacctgctcccgaaccagcagcgcctgaaccaggagccttgcctgccccagcaccagaacctcctgcaccgcctaccggatga

SEQ ID NO: 14404 - RNA, 1263 nt, unidentified
  source 1..1263: mol_type = other RNA; note = synthetic construct
atggaacgctcaagtatggagtttgaaatccattgcccatcctgccagaaggagtacctcgtataccatccttttactggagccatcctcccgtgtcaaagctgtggaacaaacatcgtcctagccattccgaaggaattggagaaagaaggcgatctgaagcagttcaggtatacaatcaaacgaggaaggaagagagaaaagccacacacaccacaccttgtgtcacccgaaaaacagttgttactgagggaagaggcgctcttcgctctgagccggtggctggaccttgacaagagtaccctagaggaggccctggacctattaaaggaagggaagggctacaacgagttcagcattagcaaggggcccggccgtgggtacagaaaaatcagcgcaccctccccagtcctgaagaaagtgcagagacagatattggataggctgttataccgaattcctgtcagtaatgcttgtcatggcttcatgcctcggcggtcgatcgtgaccaacgccaagttccacctgccaaccgccaaggtagtgtacaatgtggacctgaaagatgcattcccttcagttagcagcctccgagtgaaacacctccttgttcggtacattaagattcctctcaaacacctgggtgagcaaattgaacatgagacgcttgatgagataatccatctccttgttcagtttttgacctaccagaacagtctcccgcaaggttctccagcttccggctatctgctgaatatcgcatgcataaagctggacaaatacctgtataaactccttcgggaggagggcctggcaaaggaaattaggtatacacgctacgctgacgatctgacattttcatcacaggactctatccctgagactttgcgcagaaagattatctccacaattcgtgactgcggattccaggccaatacctccaaaaccaagtatctggaccgtggaaaaaaccaagtcctcgaaatcactggcctgatattagagaagggtgcgattcgcatccccagagataccttggaaagatatcgggctactatccaccgcgcctaccttaccgatacttccgaactgacggaggagatgaaagtggaggtgcagtctatcgtcgcctttgttaagatggtgtatccattgctgccttacaggatatctaagccctataagatgttcattcagaaacacaacatcaatcccattgggagttcctctcagtttcccctgtctcactatcccaaagggtga

SEQ ID NO: 14405 - RNA, 1272 nt, unidentified
  source 1..1272: mol_type = other RNA; note = synthetic construct
atgcgagcccagatccaatgtccgaattgctctcagaaacaccatatacaaaacccttacccagggtctttactcctgtgccctcattgtcagaccgcattattgctcgagttatcccctgagctggagaaggaatttcatctccacccaccaaaacaataccggttcactatacacagcggccgaaagaaacagcctctgacccccactattctccctccagaaacactccagcaactgcaggagaaagccttgttcgccctttcgcggtggctagatttgaacaaagagcatctgtccaatgtgctacagctgcttgagcaaaaccaggcttacgacgaattcaagattccaaagactcaaccccacacgttccgccagatttcagcacccaaagaagagctgaagctagtccagaggaggatactcgaccgcctcctgtacagaattcccacctcaaacgcctgtcacggattcacccagggacgcagtatcgtgacaaatgctaagtttcacttgcccaccgcctacgaaatttacaacttggatttgaaagacgcttttccaacagttaacacactgtgggtgaaacatctgctggtgcggtatctgaagattccgcttaaacatctgggcgagcacgtagaacatgaggtcctggatgagatcattctcattttaaccaagatgctgactcacaagaacgggttacctcaaggaagccccgccagcggctgcttgctgaacatcgcatgtatcaaaatggacaagtacctgtataaactgatagccgacaaatatcagaatacaataaggtattcccgttacgcagatgatctgacctttagttccccgactacgatcccacagagcttcagacaagaagtacagcagatcatcagaaattgcggcttttcaatcaacccttccaagatcaaatatctctctaagaagcggcagcagctgcttgaggtgaccggtcttattctggaaaagggccagatcaggattccgaagactaatcttgaaagataccgtgcgacaatccacaatgcgtacctgctccctcacgaggagctcactgagcagaaacgcctcgaagtgcatagcattgtcgcttttgtttctatggtttatagtcacctgcctaacaggatccagaagccatatcagaaattccttgaaaagcacggagggaaacccatcggtaagctgaccaagctagggtggaagacgtatcccccagaccctcccaatcccaagcttacatga

SEQ ID NO: 14406 - RNA, 2166 nt, unidentified
  source 1..2166: mol_type = other RNA; note = synthetic construct
atggggcaggataccccaaagcgtaagagaaacaccgcgcatctcactataagggcgtaccaacctctggcctcctactctgacgcggctcatcagctcctggcccagtggctggatgtggacgtcgctttactgcgagaggtgcaccaggccatcagacaaggtgacgcctactatcactataggatccccaaacccggccggcttgagtggcgagacatctttgaaccttacggcgcccttaaggagattcagaggagaattctcgatagactgctgtaccctattcgggtgtctaatgccgcccacggagccgttccaagtagatctgtggtgaccaatgccatgcaccaccttccaaatgcgcaacagctactgatgatggacattcgcaacgcttttccttcggtcagactcccaagggtgcacgggatcttccgccgttacgtcaagcccctgtttcgcaagtttggccccctgccgaacgcaaaggacgcacaacagggaccctccccagtggatgaggctctccacttcctggccgcactgacgactatgaagcagacagtagatacaccacagggaccgagggaaacatatgctcttcctcaaggcgctccgacgagcggctacttgcttaacttggcatgtctggaaatggaccagaaaatcttcaagataatagaccagaacaaggacttaggcctgaggtatagcagatacattgacgatatcactatatccacccctagtgcgatcccacccgaggtccagaacgagctggaactcgctgttatcaagaatgactttcgacttcatcgcggaaaaactcgcctcgtggagacacataacgagaacgccgtcatttgcggagttaccctgagattcgggaggttagaagcagatcccctactgctcgagcgttgccaggaagttttggagaggtccgtcgaggtggctgatccacgaacagagattaaaaggcgctcaaagattcgcggtattgtctctttcttcaaacaggtgtatggggaccaattaccttctggcctgaaagacgtgtatcagcggtatcggaaggcccgggacttgcccgaggaaccagaagttgccgcaccgaccctcgcaccagcagaaccacgcacagctgaagcccaggatgccgtgagccttttagcccagtggctcgacctgtccccgagcttggtcggtctagctggtgagttggctagctctgggttgggttacgaggaatgggagatacctaaggggaacggcaaaacccggaagatctgctcccctaaaaacgagctaaaggaaacacaggaacggatactggatagactcctgtaccacatgcccgtctcagtggcatcccacggcttcgtacccgggaggtcaatagtaactaacgctcaagcccaccttgatgcacaacatctcatcaatctggaccttaaagacgccttcccaagcgtgagtaaacaccgagtgaagctggttatgcagatcgggctgggcaatcttctcaaaaagtttgggctgaggtgcccacggagtctgcgggatgatgttatcgaactcattgcttctctgaccacccacaaagatgagctaccccaaggcgccccgacgagtggatatctgctcaatctggcctgtttgacgctcgacaagcgcatctttgcctgtttgcaggagcataaggtgagcattgcatactcccgctacgccgatgacctaactttctcgacacaggaacctctgcctgacgagcttctgggacagatcaagaagttgattgagaatgccggttttagatggcatcctcataaagtccatgtggcatcagtggccaaagggcaggctctggagatctgtggcctgagattagatggcaatcagatccgtattccccgagagaaactgaaaacctaccggagcgtattgaggcgggcggccatcaaaatccccaccggacaactcgatgcagacacaaagaatcatgtccagggaattgtgggcttcgtgaaaatggtatatggagatctgccacactcacttgcgcagccttatcaggcatttctccagactcaccctgaagctcgtcccactggtagcgctagagaaaagttcgctttatatcccaacgttctgcccgcatga

SEQ ID NO: 14407 - RNA, 2154 nt, unidentified
  source 1..2154: mol_type = other RNA; note = synthetic construct
atgtcagataactccacagtccggaaacgaaacacctcccacctcactatccgaaaacgttcaccgctgtcaagctattctgacagcgcctatagaattttgtcccagtggttggatgtcgacacctcactcctatatgaggtacttgaagctctcaaggccggcgaagcctattacacatacaagattcccaaacacggtacttacgagtggcgtgagattaatgatccttatggtggcctgaaagagatacaacgacggatattggataggcttctctatacagtccctgtgtcaaacgcagcacacggggctgttcaagcccggagtgtagtgacaaacgcactggagcatctgcctgacgcgaaagaggttctgtctttggatataaggaacgctttcccaagcgtgagattttctagagtacatcggatcttcaggaagtacattaagcccattctccgcaagcatggacccctgccctctcctaataccggaggcaaccctcccctggatgaagccatacacttgctggccgcactcactacgtacccccggagcatcaagcagaaagggcagactcagaaagtctggtgtttgccccagggcgcccccacatctggctatttgctgaacctagcatgtagggctctggaccgaaagattttcaaaattttcgacaagcacccgaatctaaatctccggtactccagatacctcgatgatatgacgatcagctcctctgttgagctgcccgcggacgttcagcgcgaattagagttagccgtgaagaagaatgactttcggcttaacagggataaaactaagaagtacggcccaaccgacacgccagtaatttgcggggtcatgctgaggcagggacacgttgaggcagaacctgagctgatccagagatgcaacgatcttctgaaaagatcagtccatgtggacgatccacgtgtcgaactgcaaaaccggaggaagattcggggaatcttgagtttcttcaagatggtgtacggggaccagatgcccaccgaaataagcgagccctatagcgagtaccgctcggcccggaatcttccgcctgaaccttccattccagcaccggcccatccaacagtcagcgcacgtgccgtggaacatcagtccgccatgtctctgctagctcaatggctggacatttctatggacaccctgaacaccgctcaccagaaatctcttagcgaggacggctacgaacactggtcaattgacaaaaagaacgggagtaagagacagatttgtagtccatgcctggaggttaaggatatccaggacaaactcctgtccagattactgtatcacatcccagtgtctgtggctgcccacggatttgtgccagggcgctcaatcgtgacaaatgccctggcgcacgcgaatgcccgctaccttctcaatctggatctgaaggatgcctttcctagcgtgtcccggaagagagtggaacattgtctcaatgtggggctaggaggtcttatcaagagattcggcctgcgctgccccactgcacttaggcaggatgttattggactgatcgcagacttcgtaacatacaaggacgccctccctcaaggcgctccaaccagtggctacctgctcaaccttgcctgtcatacccaggacaaacgaatctttgaactgttagaacgtacggctcccaatgtgacttatacccgctatgcggatgacctgacatttactagcacggagccgctccctgaaggtttcttggaggcaatacagaatgagatcaataggagcggattcaggtggcacccacaaaagacccactttgctgcagtccacaaaggtcaaaacatggagatctgcggcttgcgcctcgacgggagtacactaaggatcccccgaaaaaagctgaagcattatcgctccgtgttgcgcagagccaccaacaagctcgaaaccggtggattagataccgagacacggcataaaatccaaggcatcgtcgggtttgtgcagatggtgtatggggaattacctaggagtctgagtcagccatacgctgctttcctgcagaaacatcctgaggccagaccaactggctcggctcacgagaaaatctccttttaccccaatatacagacttga

SEQ ID NO: 14408 - RNA, 2160 nt, unidentified
  source 1..2160: mol_type = other RNA; note = synthetic construct
atgtcagagacaaacacacccaggcctcggaatcggtcgcatctgaccatccaggctcgcagaccactcgccagttatagcgatgcagcctaccggctgcttgggcaatggctggatgtcgatactggccttctgcaggaggctctggaagcgatcctcgccggtcaggcctatgagagtttcaggatcccaaagccaggaagggacgaatggcgcgtcatcttggacccttatggaggacttaaagaagtgcaacggcgaattctagaccgtcttttgtaccctattcccgttagtaacgctgcgcatggtgccgtgccagggagatccgtggtcacaaatgcacggcaacatctaccagatgcccaggagatccttagtatagacctgagacacgcattcccctctgtgcgattttccagagtgcactctatcttccgcaagcaggttaggccgctgctgcgaaagttagggccgcttccaaccgcccacagcggtacattggacccagtagacgaggtcattcacctgttggcaggactgacaacctacaagcagaccgtgcgacagcagggtagaactacccaggtgtactgcctgccccagggtgcacctacctctggttacctgcttaacctggcttgccttcccctcgatggcaagatctataagatcatcgagaagaaccccgagctgaacttgcggtattcgcgctacctggatgacctggtggtgagttcccccaatcagctgaacgacgaagtgcagaaggaggtcgagctcgccgtcgtcaagagcgattttcacttaaaccaccagaaaatagctcgcactcaagcacctgcccccctcgtcgtttgtggggtgcagctgagcggcgaacagctcaccgctgagggaggattgattgagcggtgtgccgacatgctccgtaatgccgaggctgtcagaaaccctactgccgagcagaaattgagacggaagataaggggagtaatggtgttctttagacaagtgtacgggcaggatttaccgcctaatatagccgagccttaccaacagtacagaacaaaccgacagctacctgaagagcccgaaactgtagctcaggccgtggccccggttacattggcgacggaaccctctaatgcagtggagctgctcgcccagtggctggatcttaccccagaaacgattgcggaggctagggccaagattcaagccggcgaaggctacgagtcttggtccattgataagggcaatggctccaagcgcattattacatctccagttgaccaactgaaggacatccagactcgaatcttatcacagctgatataccacattcctgtttcaaatgcctgccatggctttgtacctggccggtccatagttacaaatgcaatgacgcatcagggcgcaaccagcctcattaacctggatcttaaagatgctttcccatctgtaagcaaacatcgcgtcgaactgggactgcgcattgggttggggcgagtgatcaaaaaatttggccttcggtttcccaggccaatgcgcgatgaactgatagcattgctcggggaactgctgaccgtggacgaccagctgcctcaaggcgctccaacatccggttacctactgaatattgccgccatgtcactggataaaaggttattcgaactcatccaggagcatgatcaggaagtgacttataccagatatgcagacgacctaacttttacatgcaaggacggagagctcactacggatttcctcaacaaattgaaacgtgtcatccgccgctcaggattccggtggaatccacgcaagacccacagggcagaggtggataagggccagcagattgagatctgtgggatctacgtggacgatgacgggttaagactgcccagggacaaaatgaaggcttaccggagcatcctacgtcgggcggctacccaaattcccaccggccagctcgatgacgctactaaacgtcaaatccaaggggttgtgggatttgtggaaatggtatatggcgaactgccaagaagaatcagcgagccctatcaggcgtatctccagcagcaccccgacgctaggcccaaaaggctctacagggacaaaatttccttctatccgaacatcatgcctaacccttga

SEQ ID NO: 14409 - RNA, 1038 nt, unidentified
  source 1..1038: mol_type = other RNA; note = synthetic construct
atggaactcaatagacccgccgacaccgctttcgcaatgctggcccggctgttgtcaacagacaacgaggtggtgcgcgcgggacatgaagctctcagtgggggagatgcctaccgcagttgggaggtcccaaaagggaacgggaagacgcgcagaattgatgcccccgtggaagaattgaaacaggttcagagcttgctcctgactcgcctcttctgccacgcacctacatctccatttgcccatggcttcgttcccggcaggtccatcgcaacaaacgccgccgttcaccagcagactgggagatcactggtgtctcttgacctggaggacgcttacccatccgtatcgcgacagcgggtcgtaaaaaccttagagtggggcctgggctacttcctgaagcacgtcgctccttgttcaagtcgggagagcagagacgaattgtatgaactgattgcagacctctgttgttttcggcaatgtttgccccaaggggcgcctaccagcggactgttacttaacatggcgtgctgctccctagatagaaggtgtgctcgactgctaagaaggtgccgagatcagtttccagaactccgttataccaggtacgccgatgacctcagctttacctccagcgaggagttatcccacgagttcctggagcaggccataggctgcgtagtccaagcaggatttcgggtgaatcggagaaaggtcaagaggtattcggtgcgcaatgccgacctcgttatctgcggaatcaggctgcatgagggccaactgactctgccgcgccgagtgcttagaaggtatcgtgccctacttttccagtctctggcttacggccctgatgaaataagcgaagagaataggcagtttctgcttggtcatatcggcttcctgacaatggcttcttccgtgtgtccgcctcagcttgagcggctgctcgaggaagtgttacagcagcacggatcatggctgcgcagtggtgtggcatctcacattttgccctcttacggtgaggtggggcgtagctga

SEQ ID NO: 14410 - RNA, 1035 nt, unidentified
  source 1..1035: mol_type = other RNA; note = synthetic construct
atgggcatgaatgcctatgccgacagcactttgtctctcctgagccgactgctcatgacagacagggagactgttaatagtggctttgaggctctctctggagttgcctatgattcttggacagtgccgaaaggaaacgggagggaaagacagattgatgcccccgtccctgaattaaaaagactgcagtcactactgctcaagaggctgctgaacttcgcgcccatatccccgttcgcccatggattcgtgcggggcaggtccattgtcacaaacgccgctgtacatcgcgagactgcacggtgtatggttagccttgatcttaaagacgcatacccctcggtgtccagggatagggtggtgaaagcactgcaatggggagtgggatcattcctcaagcatacatccccagaaaccacccggggcgaacgtgaggctgtgtttgaggccgtggctgacgtatgcactcatcgagacgctcttccacagggcgcccctacgtcaggccagctactgaacatgacctgctgcagtttagatcgacactgttctcgcctgatgagagcaagccgggaagagtttccagggttgcgctattcaagatacgcggacgatttggcctttacagccaccggtgaattgagccacgagtttctggaaagagccatcggttgcgtcctgcgagcggggttcgaggtgaatcggcgcaaggtgaagcgctacactgtagctaatgccgacctggtgatctgtggaattcgtttgcacgacggtcagctcactctaccacgccgtgtgcttcggaagtatagggccctgctctttcagaccctggcaagagaacctgaggatatgagtgacggggctcggcaacacgtccatggggctatcgggtttctgaccatggcaacaaccgtctgtcctccccagctcgaggatctgcttcaggctgtcctgcaacagcacggcacctggttaagacctggcacggttcccgcacacttcccattctacagctccttcagtcaaaagtga

SEQ ID NO: 14411 - RNA, 2934 nt, unidentified
  source 1..2934: mol_type = other RNA; note = synthetic construct
atgacggaacctactcagcgggccgctaggctcgcacgtctgatgagccgcggtgctgccaccggtgctagtgaagcccgggcaacaccccacgaagctgcaaggagggccactcaggtactgatcggggcattgctgccgggcgacgtcgaattgcaagccgccctggggggtgatttgtctgccctggagcatgcacaaagacccggcccagcgcaagccttgctggatgctctcctggatgctctggagggcccattatcggcccctctggcaggctgggtggaacttgctgagggaggggcgtctgacggtgccttatggcgggctgtggacacccatcttgccagacccgagtgtctggctctccggagggccttaacctctaggtgggccgctttaccctcaacacgcgcccgtctcagtgctctgatcgatgccaggccatctctgagaggtgcacgaggccccctgaccggattgttgtccgccgctctgtccgcctcagagagtctgcggggttcaagactctccgaggccctccgggttgaggtttacgtttcttacagaagattccagcgagcactcctgtcagacgatttgcgatctgcaggagctgcgctggatgacctgttcgggtacactcccaatcgcccggccctgttaatcagcgatgccgccctctgtgtcctcgagggtagacctggggaggctcgtcgagcactgtccgaagcgctcgctttcatccacgaccatgccgccttggaagccgcctacgctgctttagcagcaccccccaggttggagaagaccgcagctgcccctcgccatagtcctagggatctgcggcctcgattaggcatcgaggggagggcagtgagagcagaagggcgggtgtataagcctcgcttagacagatggagcccccggccgtcctatgcaagatgggtcatcgaggccgtggcggcagctttaggaagggctcctgaggccattgacgccgctctgaccaccctccacagaggagaggcctaccgagcattcacaatcacagcaccctctggcaagcctcgaaggatccaggcgcctcaaggcgctctcatcgagattcaggcggccatactcgagggcctgctgtatcgcctacccgtcagcaatgccgcgcacggagccactcctggtaggtcactgattactcaggccgtggcccatctgcctcagcctcgacaggccctgtccctggacctgaaagacgcctatccatcggttagctttcagagggtctatcgcgttttttacgaggggctcgcacgcctccttccagtagcacgcctgccaggactcgaaggccttcgccctctcgtggcgagagatcacctcgcgcacttgctggccactctcacctgtgcaccccttcaaggcgccaggcccaaacccaaaacagcttgggcactgccacagggtgctccgacttctgcagccttgctgaatctagcatgcgctgacctggaccgaggcgtgtacaagctgttgcgagcccacccaggggtggacctgaggtacacacgctatattgacgatctgaccattacagctacaggaggcgctcttccggaaggcctgacccgtcaactggagcgcctgattgagagagtgggattttcctcccagccgctcaagcggagggcatggagagtaggcgaagggcccctaatcatttgcggacttagcctagagtccggcggggtcgcttttggacctgacttaatcgcccgggctgccacgttatcagcgcttggcgctccaggagccgcggaattacgcggactagccgcttttgcccgacagatttatgcccagacgccccctttcttgcagagttgggcagaagccgccccggcaagagcatggagtagtccgcgggccccttacttgcgttacctgcagggcgatcccactgcagcagctcctggcgtcgcccaactggctagatggctcgacgcccccatggctcaagtggaacgggcccttgcgctcttggaagctggtgccgcctacgccacgtggagactgtctaaaggcgggggcggagagcgcgaaatcgaatccccagctgccccacttaagggcctgcagacccgcatcctgcataggctgataagccgcgcacccttgtccgcagctgcacatggctttgccgagggaagaagcatcgcgacaaacgccagagcccacctaggggctgcagcacttctgaacgttgacatagaggatgctttcccttctgtgagcgcccagagagtgagacatgccctcgatagggccctaggcccacggttagcatcactggggcccagcgctgaagctgctagtgaggccctgggtctgctgacacgcctgctcacctataggggtcggcttccacagggggctccaacctcaggcgcgctattcaacctatgtctcactccacttgatcggctactcgaggatgcctgcggaccccgaggcattacttacacccgttatgccgatgaccttacgttcagtagcccacgcgtggaggcgatagatgcggccttcggggaccagattaaacagatcattcaccgggccggctttaggtggtctgcccgtaaatgggcacggatggcggcgccaagactcgaagtgtgcggggtacgcctggacggagctcatctgcgtctgagcagagcacagctgcaacggtaccgggctacccttcaccgtcttgcccacgcccctacactggacgccgaaggaagggataaggcagctgggattttggggtttgtccacatgatatatggagagctgccagctccccttaggggacccgctcaagcattgaggcagcggcaccgccttgagccaaagccaaaaagcaagctcgacctctatggtcgggggtga

SEQ ID NO: 14412 - RNA, 1059 nt, unidentified
  source 1..1059: mol_type = other RNA; note = synthetic construct
atgcccggcaggtctgctactaccctgctggcaaagcttattgacttaccggcaagggaagtggaggaagcattggccctggtgacaggcggcgaggcatatgataggtttgagatacccaaggtcggcactagggccccacgcgttatccaggcacctgtggagcgcctcaagcgggtccagagagctcttatcggtttgctggaacccctggctctgcatagcgctgtgcacgggtttcgccgtggccgaagtattgtcaccggggcagagaaacatttgcaggcgagggccattctgaacattgacctcaaggacttctttcattccgtcgatcgggatcgggtgaggcgtgcgttacagcgctcactcctgccacgcttggttgaagaaacaggcgaactgacaaaagcagaaggtgatgccgtcgtggccctggtgaccgaactcacgacatatgctgtccctggaagagacttacccgtgctgcctcaaggagccccgacctctcccttcctagcaaatctcgccgctcggaaactggatcaggagattagcgagctccttgccggactaccgggagaactggtatacacgagatacgccgacgacttgacaatctcggccccacacgaaatcgacagaaggcttataggggaaatcataaagcgagtgcagagggcaggttttgctgccaaccctcaaaaggttagactggccagtaccctgaaaggtagcccacattaccgccagaagctcgaggtaaccgggttagtaatcgatcctcgagacaaagttctccgcatcccccgggatcgcctggagttgtaccggctgaagattcaccaagccgcccaccttcgtgagctcgacccaggaactagacaggagatcgaggggttcgtgtccttcgcctttatggtgtatcggaccctgcccccttccctggctactgcatacgagcgattcacagctgcgcacagactagcgccactccaagctggcaagtcacggcgagccgctagaagaagggccactcagaaagagctttatccttga

SEQ ID NO: 14413 - RNA, 1056 nt, unidentified
  source 1..1056: mol_type = other RNA; note = synthetic construct
atgtgtgacccgtgcggccttgacccccaaggttcctggccaccagtggcaatagagactcccaccgtgctgtctgccgattgcaagatggcgttggccgacttactccagttgcctagcgggcagattatctcggcatgggacgcagtgaggggaaacgctgcctacgactggcacttgtttggggccagagaagttgctgtgccagtccctctgctggccgatgtccagagacgcgtgctcgatagggtgcttcggacaggccctgtgtctcctgcagcttatgctggagtgccaggacgaagctacgttgccgccgcctggaggcatttaggcggcacaggcgctgaaaccgtcgtgatggatatagccggcgcttttgggagtacgacctacggtcacgtgcggagcgccctgtctagacggctcaagcacgaactgtgggtacttggtctggactccgatgatgctaaagcagtcgtccaggtgattgcccatcttgtgacagtcgatatggatggtcgatccagacaactgcctctcggggcacctacctctgtcgccttgtttaatttagtactcctgtcactggacggtgacctcgcgaggtggtgcgttccacgcggaatccgctatacacgctatgttgacgatatggtcttcagttgttccgagggagtacccaatcagctggaagagtttgtggagcataacgtcgagaggttccgtttccggttgaatcagaacaaaaccgtgcgcagtgctgcagggatgggcactgttcacggcctggtgcggactgctgacggaatcgtaccgggggagggcgctagaaggcgatttgcagacaatatccagtggcacacgagacaggccgaagacgaggccacttcagaggcgcatagggagaagtcaagagggttcctgaaaggcctgaacaccttccttcgtcaattctacgaacggcaggatctagcacgccccgaaatgctcaagattcacgttcccgaaggaagcacagccgcgagccccctagtggatctgctgtgggagtga

SEQ ID NO: 14414 - RNA, 906 nt, unidentified
  source 1..906: mol_type = other RNA; note = synthetic construct
atgtggcgctggtggttgagactggccccagcagggcgttcggaagtcgctgttcccgtgcctgtgctttcagatctgcagcgccagatcctcgagcggattctgcggacaggacccgtcagccctgctgcatatgccggagtgccaggcagaagctatgtagctgcggcttggaggcacttgggaggttccggtgccgagacagccgtgctcgacatcgccgatgcgttccctgccaccacatatgggcacgtccgcgccgctctgtttagaaggctgaagtccgaactctgggtgctgggactggaccccgcggattctaaagtacttgtgcaggttctgtctcacttggtgaccgttgacaaggggggccggtctaggcagttaccccttggctccccaactagtgtggcaatgttcaacctggtgttactccctctggatggcgaattggccaggtggtgcaagcctggtaaaataacctacactcggtacgtcgatgatatggtgtttagccaggccgacggactaccagtaggcttagagacgaccgtgcatcgggccgtggtcagacacggcttcagactcaatcctgcaaagactgtgcgacgccctgctggccaaggaactgtccatggcctagttcgcgtagccgcagggattgtgcccagcgaaagggcccgagagagatttgcaagtaacatccgttggcattccgacagaaccgccgacacgacaatcccggctccccaaaggcagaggagtcgaggttttctgaaagggatggacacctacctgcagcaattctacgagcgccaggagatttcacggccagggtcactggagatccagataccagaaggcgctgcagttccgccacccgctgtcgatcttctctgggactga

SEQ ID NO: 14415 - RNA, 1014 nt, unidentified
  source 1..1014: mol_type = other RNA; note = synthetic construct
atgacggtcatcaccattcctgatcctcttagtgatgattgccgggtcgccctgagtgatttgctgaggctgccagttgagcaagtgatggctgcctggaaagttagccaaaccgaccggggttacgattggaatctgtatggggaccgtgttatccacgtgccccagcccttgctcagcgaggtgcaacggcagattttggatagggtgctgcgaaccggccctatcagcccagcagcctttagtggagtgtctgggcgctcctacgttctcgccgcgacacgacatctatcgggccctccagctgagacagctgcattagacatcgcagacgcgtttggatcaacgacttatgggcacgtccggggtgccttgtggaagcgactcaaacaggagctgtggatactgggtctgtccggctcagagtcaaccgccattgtaaaggtactgagccatctcgccaccgtggccgacagagcaaggactcggagactgcctttaggatctccctcctctgtggctatgttcaacctcattttactaccccttgatggcgaaatgctgcgctggtgtagcgagtatgggataacttatacaagatacgtggacgacatggtattttcatgcccggacgggttgccacccgatcttgaaagccgggtggaggccgtggtccgcagacataggtaccgtctgaatcacggcaaaacaattagacacgctgcaggctctgcccgcgtgcatggacttgagcgcactacagaaggcgtggtccccggagctgacgcagtggaacggttcgccgctagagctagatggcaccagggaaaggcagtcgatgaaacctcctcccgctctcagcgagagaggagttacggtttcctcagagggctggacgtgttcctgaggcagttttacgaggcgcaggatctccagaggccagactcccttaggatcgtcgtaccggaaggcgccgaacgtcccgttcctccaatcgacctgctatggaactga

SEQ ID NO: 14416 - RNA, 999 nt, unidentified
  source 1..999: mol_type = other RNA; note = synthetic construct
atgaaaatgctgcctccagagtgggagcagttgtgggaatgcactaggtcggggaatgaagtcacggacgaggtcaccttccacgctcttgagtggctgtatgataacaggacaaaaaagggaacctggttccacaacccattccgcgtggaaaagaagaataagcaaggccagttccgccttatctcctgggccggcccacaactctctattgttcacttagcaattagtcggtggcttaagcatgagtatgtgagaaagagcatggatgctagcacacccggagcaggaggcgtgatggtggccttgagagcccatggagataataagtttgtaacactggtggacgttgctaacgcgttctcctccgtgtcagagcgaagcttgtctgccgccctgcgatgcctaatggatgatgtcaccgaggaattcctggatgtgctactcgagctcacgaccgtagacggccatgtctggcagggttggtccgtgagtaaagacctcttcaacctcgtgatgttaaatctggatcctgtagtctttgaccagctcccctttcttggggtcgagatctatacacgttacgtggataaccttatattctcatctagcaaaccgtacagccctattactctggagcggtttttgaggcacgtgttcaagcagtgtgggttcttgctgggcccatttcagcattccgaccagggaagatattcatatctgggtgtgatggtagaagaaggtaactaccgtccccaggacgttaaacgctacgttgtcgagatagaaaaggccctgcaacacccgtgtcctcacttatactattggactattctcgggtacttttcatggaccctgagcgtgtctagggacaatatccccaaagaactgtttgaggtgttcgaacggtactttaaactggttggcatgatccctcccgcactacagagactgatgatcatgcggtaccagatgagttttgctgacctgcaaaattga

SEQ ID NO: 14417 - RNA, 1038 nt, unidentified
  source 1..1038: mol_type = other RNA; note = synthetic construct
atgacagaaaagaagtacaaactccagccactggaaaaggtcagtcttgatgtgcagttttcctggaccatgggcattatcgccaagttactcaaaataaccaagaagaatctcagaaaggccaagaaaatcgtctcggccccaaagtacgacgatgaaattctgataaatggcatgcctacccagatcacattccactatggattctacgggttcatcaagaaaatcaagcgcaaacagcgcaaaattctggcaccccacccgaagctgcagatcgtgtttcgggcaatcaaagacacattagtcgaaatggaacccactcacgagaacgcctttggattcgttaagaaacggaacgtccagatggccgtgagatccctccttggtaacgctcattttatctcatttgacattgcggacgctttcccgagcattactgctaagatggtggagaactctttgaagaagctgaaactacaggaggagctgatacaacccttgactcatctggtcacctgcgattacgatcaagagaggaggctgccacaggggtctagctgttctccagcaatcctcaacctcgtgtacaagcccatgtgccaggaaatcgatcgggtttgtggtacacataatatatcatggttcgtatatgccgacgatttcaattttgctgctctagtgattccccctcaggcgaaaaatgaacttcttgccattccacccaaatatggctttagcacgaaagcatccaagacaaaggacaacttggggaaaactatccctcacatgttgggcctgacgattgtggacgagaaggttcacatacggaggcgcactaagaaaaagttcagacgaatcctgtacatggcgtggaaatatgaggcctacagccctcaacagattagaggggtagctgtggccattcgtcaaacctatggaaatgagaagaactggcctggttggctgaaagagtactggatcaaatatcaaaccaagaggcaggcagaaggcggacgatatgagaaaagtgcccagtga

SEQ ID NO: 14418 - RNA, 1035 nt, unidentified
  source 1..1035: mol_type = other RNA; note = synthetic construct
atggtaagggagaaacatgaactacagccaatgaagaatgtgtcactggacgtgcagttctcttggaccatgggcattatggctaaattcctgaagactactaagaaggaacttcggaaagtcaagaagatcattgacgtgaaaaacctcaaagatcagatccctatcaaaggctcgtttgttaagatgacatttacacatggattctactcctttaccaagaaaattaagcggaaacagcgaaagattctggcccctcatcccaaagtgcagatcgtactgaaggccatcaaagatacgctggtggagctctctccagcccacgaaaatgcattcggctttgtcaaaaagcgagatatccagatggccacgaggtctttgctcggcaacacacactttattagctttgacattactgatgcgtttccctccatcacagctaagatggtggaaaaagctttacgtaagctgaaaatcggggaggaacttataaagccgctgatatggttgaccacatattattataaccaggatagacggttaccacaggggagtagctgcagtcccgcccttctaaatctggtctatgttcctatgtgccaggagatcgacgaggtgtgtaaagcacatggtattaagtggtgcgtgtatgttgacgatttccacttcgccgctctcaagatagttcccgacgtcaagaaaaaactcttgaccatcccgtccaaatacggattcagcataaaggccaagaaaattaaggacaacttcgacaggaccattccacacatcctgggtctgactatagtcaatgggaagattcatatcagacgctgtacaaagaaaaagttccggaggatcttttacatggcatggaagcacggagcgtactcacctcaacaggtggaaggaaccgtggcagctatcagacaaacctacggtaaggagaagaactggcccgggtggctgcgcgagtattggaccaaataccaaactaaataccaaactgagggaggccgcaatgggaagcacggctga

SEQ ID NO: 14419 - RNA, 999 nt, unidentified
  source 1..999: mol_type = other RNA; note = synthetic construct
atggccattagtaatgagatgtgtcccctgagcgtggcctcgattcaggtgcagctgcagtggactctcgggggactgagcgagctgatttcagtccccaagaaacaattgaagaaagcattcaagatcgtgtcaacacctaagctcgaagcaaccatcatgaagagaggggggctggtacgaaaaacttttctttacggctttgccagctacataatcaagaataagaacaaggaacggaaaattctcgagccccacccagaggtccagaaggtttacaagaagataaaggaatggctggagaaagtggacccgcctcacgaacgcacattcggatttgtcaaggaccgcaactgtaaaaaagcaaccgagacattgtctgccttgttcaggggtggccaccacgtcgcattcgacatagccgatgcttttccgaatattaccgaagaaatgatcaaagaggcgctgctgcggcttgaaatagaggttgatatggctgaggtgctggcctggtttgtgacctacaactatcagggcaaacgtagactgccccagggctccagtagctctccttccattttaaacctcgtctataaaccaatgtgcaaggagatcgacaggttttgccaagctaacggcatcgaatggtccgtgtatgttgatgatttcaacttcgcggctccttctattagttcagagctgaaagacgccttactcagcatcccctcccaatttggattctctattaagcctaagaagaataaggacaatctaggcaaaacgatcccacatcttctcgggttgacagtggctgatggaaaactgcatttctcacggactcagaagaagaaattcaggggtatcttttatcttgccgtgaagtaccaggagtatccacctgaagtggtacatggtattatgagatacgttcaccatatctacggacccaaagagaattggccaggctggctaatcaaaatggggggtacccagtcctga

SEQ ID NO: 14420 - RNA, 924 nt, unidentified
  source 1..924: mol_type = other RNA; note = synthetic construct
atgcttgagaacaagtctggttatcgggtctggtctattccaaagaaatcaggagggaaacgccagatccaggctgccctttggcccctgagagaaatccaggcgaggattgccgctctgatatacccctatagcatatccgagattaatcatggattcatccctggcaggagccaccagacagcagtattgccgcacttgctggccaacgctatgttttgttgggacattaaagacgcgttcagttctacaaccaagaaacaagtgctgctgaaattcagggtcattggatttaacaaccctctcgccgacctgatggccgacctggtgtgctactccgcaacgggtaagtcagaggatgggtttttaccacagggctactgttccagtcctattatatttaacctcgtgctgaaggacatcgatcggctgctattcctgtttgcccagcagcgcgattaccagattagtcgatatgtggataactttgctatttcgaccccaaagaaggaaatccctcgacaagatcgcgaattggtggtgcgcatagtcatgaatctcagcaatggctcatacaaagttccggaagaaaagacttcctacttcaaggtggaggaggacaaagtatgcttcgaattcctcgggctcgttatcaaaggcccaaaaaagggcaaacgtgagattcgggtcactgacgagaagcttgctgattatagatggaccatccatgacgccttagagaaaggtgactttagcgatagaaaggtcagagagatcagggggaagatcaattacctgaagagcgtgtatcagcgtcagtccttgcctctccccatccggatcatggaactatatttccagtaccaacaaatggcagaggttgcaaagacaggacagctgcccctgaatctttctggcccctga

SEQ ID NO: 14421 - RNA, 918 nt, unidentified
  source 1..918: mol_type = other RNA; note = synthetic construct
atgctcgagacaaaaaaagcataccacgtgtggttcatcccaaagaaaccggccggaaagcggcaaatccaagcagctagatggccccttaacgaaatccaggtccgaatcgccggtaagatttacccctatagcattagcgagatatcccacagttttgttccaggtcgctctcatcgtaccgccgtgtttccgcatctgagagccaacgctttcttcaccttcgatattaaagacgcttttcccagcacgcgcaagaagcaggtagccgctaatttcagatggatcggatttaaaaaggccgtggcggacctgatggccgacctgatttgctactcacctactgaaaaatcagaggacggcttcctccctcaggggtatgcctcctctccaaccgtttttaacctgatcttaaacacaactgacagggtattgtttgggttctcccagaagagagggtatcaggtgacgcgctatgtggataattttgctattagtgcgacccagaaaacaatccctgaggaggagcggaagctagcgatcaagattgtcaaatctcttagtctgggaaatttcaagattccagaggaaaagacatcctatcgggaggcaggcgaaaaggaagtccacttcgagtttctgggcttggtgatagaaggtcctagggatggagagcgtaaaattggcgttgctgatgaaaagctggcagactaccggtgggtcatccaggaagcactggataaagaagattttagcgagggcaaattcagggaaataagggggaagatcaattacctcaaatcgatctaccagggccgcgccttacccaaccaagtggccgagttgtataaccagtacagactgcttcgagagatcataaatactaccaagagggggcaactctcactgcccatttga

SEQ ID NO: 14422 - RNA, 1017 nt, unidentified
  source 1..1017: mol_type = other RNA; note = synthetic construct
atgatcaccccgggtagaaaagaagccatttctgagctggcagtggctttggagatcagtcctaatctcatcaatcgggccctccaaatgattacagacaagaccgcatacaatgtgtggagcaccccaaagaaatccggcggggaacgccaaattcaggcggcaaattggcccttgaacgagatccagtccaagattgccgccgagatatacccatatagtgtctcagagattaaccacgctttcgtcgctggaaggagccaccgaacagcagtgctgcctcaccttagagctaatgcctttttctcattcgatatcaaggacgccttcccgtctgttagccgaagacaggtcctcctcaagctgaggctgctctcggttcagctgggcctaaaggacagagtggctgagcttattactgatctggtgtgctattctcccactgggaaatctgaacatggcttcctgccacagggctatcgcagcagtccacatattttcaaccttgtcctcaaggacatcgaccggatattagccggatttgctcaaaaaaggggctatcagataaccagattcgtcgatgattttctaataagtacgacagagaaagccatcccccgcgaggatcgaaggctggtgattaaactggtagaaaacctggggggattcaagatctcccctgagaagatatcctacctggagagcgaaggaaacgacgttcattttgagtttcttgggttggctatcaagggtcccagggaaggagaacggactatgggtgtggcggaaaagaaattgaacgaatgtcgttggatcatcttaggcgcaatggagcagaaggatttttccaagaaaacctttcgtcggattaaagggaaggtgaactacattaagggcatttacaaaagccagggtaaacccctgcctgcgaagatcgccgatgtatttgcccagtaccgctcattacgggctatcgcagacgccgacaagaatcaacaggtgctgttcaaaatctga

SEQ ID NO: 14423 - RNA, 987 nt, unidentified
  source 1..987: mol_type = other RNA; note = synthetic construct
atgaacaatgaaaaactcaagaagggcataaacgagatttgcaacttcctggagtacaaccctggcatcatggatctggagaaagcattcgagggacgcaatagttaccaacgcatttttatccgtaaacgcggagggaaaaagaagggaaagcgggtcattcacgtgcctccccccaagctcaagaatgttcagtcagttatccaccggcgagtgttagagatggtggaatggccagcttctgtgcatggcttcgtgaagaatcggtcccacttgactgccgctctgaaacatagcaggtccatcccaccccccgtggctcttttactgattgactttaaggacgcgttcagcaacgtcggcgtgaaaaaagtagaaagagctctggataagaggcttcagcctaatctgctttgtcccctgagtccaggggccatcaagctgcttgccaagctgatcacctacagagggcgactgccgcaaggagccccatcatctccgacaatttttaacctagttgcactcgatttggacgaggttctgagcgtttacgccgaggaaagaggctatacctatacgaggtatgtcgacaatatagccgtgtcctcacctaagcctattcccaaaaacgaaagagcggagatcatcggcctgtgccgacagtttggatttcaggtggtgagtgaaaaagcccgctaccaggaagcaaagtggggtgtactcgagatgaccaaagtcctgctgcagccctatggtggtcaaaaatggtatgccagctacgggctaggcttgtctaataggaagttcgtggataaggtcagggctatggtgcatagagcacagaaagacccatcaatctccttggcaagcatttgggggaaaatagattacgtccgtttagtagacccatataagttgagttcgcggctctccaagcctatgagacagctccggtctatacagagcaacctcgagcgcaggaaatga

SEQ ID NO: 14424 - RNA, 981 nt, unidentified
  source 1..981: mol_type = other RNA; note = synthetic construct
atgctgacgcccttgggatgccggttccaagagctggtgtcccgcgctgctcagttgctggcagtggagccggctttgatcgagcaggctctccaggaaaaggggcagtaccagcgacggacacgcaagaagcccggtaaggatgccgagggtaggccgagaatccgagtgttgcacgtgcctcctccagtcgtcaaagaggtgcaaagggctatacacagacatctgcttaatctgggtaacagctggtttaggaaactcggcagtgatttcgcttggcctatcgccatgcatggctttctcccaaggaggtcgaaccttacagcagctcgtgatcacatcgggaacacagccctgttcacactggacttcgctgacgcatttccctctgttaggcgggaacgcgtggccactgccttacggtggcatgcgaagttaggacggcaggaagcaaattttattgcgcgccttgccacgtatcggggcagactctgtcagggctcacccagctcaccactgctgttcaacctcgtagttcttaatctactcaaatctctggagcggttggccgcagaaagggggtaccgtgtgactatctactgcgacgaggtagccattaccgcagataaacccatacctgccgaggaaagacgggcgatcctgcagctggtcattcaggccgggtttgcagtgcatccaaaaaaaatccgctatcaagaagcccgctggggcgccttagaggttactaaggtgctcgtccgtccagacagacttggcctcagtactagacacaccattgatagggtcagagcattcatagatcacctggcccgaagaggaaccgctgacaccaaggaattggccaaggctaagggatatattgggtgggttgaactggtggaccctgagaaactaaagacccgcctgcgaaagtccctggcccaactagcgaaactggagcagtccggcggacacagctga

SEQ ID NO: 14425 - RNA, 1017 nt, unidentified
  source 1..1017: mol_type = other RNA; note = synthetic construct
atgcagcaggctgagctgccactgtcacccaacaatgccccctggccggacgattttaggacagcccttggcttggacgaagccgcgcttgcagaggcatggatgcatcgagccgactaccggcctcatcgtgtccctaagcgcaaggcgcgaaggattggacccaagcgggagcctcgggtggcaaagaaaaagagacgcccgattgatgaaccacacccggctctccgggtcgttcaagaggccatccgcaggaaactactcgagcagatcccactgtccgcatgcgctcatggctttagaaaaggtcgctctgctaaaactgcgctcttgccccaccgcaagtccacgagcttcttcactgtagacttccgcaacgcattccataaggttaccggtgcaatgcttgctgaagccctgagagcctgcacacccattattaagcccaggtgggtggcgcctttggtcgccttcacaacgcaccgaggccggttaccccaaggtgctcctacctcgaacgatctattcaatatcgcatgtcgagaacttgacgccaacctggctgcctttgcccagactagggggtttgtctatacaagatacgcagacgccgttattattagtgccaaagcacctctgccaaccgatctccagcgggaaatcgaggccaagatccgtgcttacggctttccactggccgctgagaaaactggctataccgaaccaaggtacgctcacccagtcatcatgggaatcgcggtggtggatggccggttaagagtgcccaggaggcagctcgatcgtgctagagcttttctgcatcgcgccaaactggaccctaccataccgatggagattgtggagggggtgctggggaatgtgcgaggacttataggggggctgccccccagactgctgaaaccttataaggccctcttgatgtctagacacttatgggtgaggtacagacggcggcgcggaatcccatatgtagcacacagccctatgcagccatga

SEQ ID NO: 14426 - RNA, 990 nt, unidentified
  source 1..990: mol_type = other RNA; note = synthetic construct
atgccagcaccttggccagatgatttcagaaccgctctgggtcttgacgaagccgcactggctgatgcttggctccacagggccgactaccaaccacaccgcgtacccaaaaggaagccccggcggatcggaccaaaaagacagcctaaagccatcaagaagaaacggcggcccattgatgaaccacaccccgccttgagagtggtgcaggaggccatcagaaagaagctgttaaaacgtattccgctgagcagtgcagctcacgggttccgaaaaggccggagcgccacaactgcactgattcctcaccgcaagtcagcagccttttttacagtggactttcgaaatgccttccacaaggtcaccactgcaatgctggccgacgctcttagagagtgcgcccctatcatcaagcctgattgggtgccgcccctggttgctttcaccactcataggggccggctacctcagggagcacccacttcaaacggcctgtttaacatagcgtgtcgcgggctcgacgccaatctggctgccttcgcacagacccgcggatttgcgtatacaaggtacgcagacgccgttatcatatccgcgaaggtgcccctcccaacatctttacaaagggagatcgaggcgaaaattcgcacccatggattccccctggccgcggaaaagactggctatacggagcctcgttacgctcatccggtgattatggggatagccgtagtcgccgggaggttgagagtgcctcggcgacagctggatagagctcgagcctttttgcatcgagcaaggtacgaccccgctattcccatgaaagtggtcgagggggtcctaggcaacgttcgcggtctgttgggtggcttaccacagagactccttaagccatatcgggaactccttaccagtagaaatctgtgggtccatccacgtaggcgcaggctcgctcctcctcttacgccgagcacatcttcccccccatga

SEQ ID NO: 14427 - RNA, 1224 nt, unidentified
  source 1..1224: mol_type = other RNA; note = synthetic construct
atgagggataaacgccaactggggatcttcattcccggcttcttagatgactccatgttgaagttggcagtcccacagacagcgcggatgatcggctacgaggagaagcatttgcccttcttcagcagaaccctacgacgtgtgctgagcgaccctaatgcctatcggagtgtgcagatcccaaagaggctcggtggctatcgaactctggatataccaaatcatgatctcatgcaagttcaacggcgtatccactcctgcattcttgtcaggcgctatgtcccctcccccatctgccactccttcgtggggaaactatacgatcggtctggagctgccgaggagaggtggcaagccggacgatcaatattcaccaacgcatttgctcatcttgcaccaggaccacgcgccaggagggacgtaagaataccatcgtctattttaactgtagatctgaaagaggcttacccttccatcgctgcagaccgcgtgtttcgcgtgtatcaggaactgactggcgatccttggactgcacagattttgacacacctctcagtgtggagaggctgtcttccacagggggcccctaccagtcccatgttgcagaacctggtgtaccgcgagctggacgtcgccttggcaacggaatttaacaagggtccgtttagactgacccggtatgccgacgactttacactgacgtctctcagggggtatatcgaccctaagatcgtaatccaccttatcgaagtggttgaggctcacggattccctgttaacagacagaaagtgctccggtggagacgaaaagatcgtcgcctgagagttacaggaattaatattaggcgcaccgccgagcggccgttcagtttacccaggaagaagctggagcagctcagagctgcgcttttctacgccgtgaagaccctgcagagcactgcgcggtacgaggctgaaagaagggccgcaggtacactggacaccacgacagccaaggctctcgaccaacttcagaaacagacctggggccgtattcatggcctggtcggctttgccgtccaggtttacggggatgaactgcccccgaccatttacaaatggtttggcttcctacgcgaagaaactgaagtcacaggtgaggaactcctgcagcagataagagagagctttcctgtgtctgaggtgcagcgaagcggacgggaactgctcggggactcaccctga

SEQ ID NO: 14428 - RNA, 1101 nt, unidentified
  source 1..1101: mol_type = other RNA; note = synthetic construct
atgcagcagagactgagcgacccttactgttacagggcaaagcaaattcccaaacgcctgggtggcctccggacaattgacgtgccatgcccaagactcaagaaactgcagaggaggatccacgatttcttgctgagacgtcattaccggccttcccgcatctgccactcctttgtggggaagttttacgatgtcgcccggcccgctcgcaaaaggtggattcccggcagatcactctttaccaatgcttgggttcacctcggagtgccgcccggtgtttctccacgcagcaaaagcagacgaatacactggagaataccgaggtctttgttctccgtagacctaaaagatgcttatccttcaataggagtggatcacgtgttccgtatttatcaggagcttaccggcgacccttggacagctcagatcctgtctaccctgagtacttggaacgggagcctgcctcaaggcgctccaaccagccctttgcttctcaactttgcatgtagggaattagacggcgctcttgcccatgaatttactcgggggccctatcgcctgacacgatatgtggacgacttcgtattgacgtcgacagaccctgagatttcagaagctactcgcgagagattcgtggcaattatcgagcagcacggattcaagattaatcaagcaaagacctgctattggagggataccgatcgagccctccgggtgacaggaatcaacctttttccccaggaacggcatatcgggctgccaaatgtcgtccaacggcagttccgcgcagccctgtactacgcactgaagtcactggagtctatccatgcctatgccctgcagagaggcgttttagacgagacaaccgccatgtccctaaggggagcggagaagcaggcctggggtctgatctacggggttattggcttcacctatcaagtctacggtgctaaaataccgcgtccaatatacgcctggatcccagagttaactgcgcgaactggggtcacttccgatacgctcgtggccaagatcaagaaataccctcccattgcggccatccagcagattggagaagaaatcatcggcagtagtccctga

SEQ ID NO: 14429 - RNA, 1149 nt, unidentified
  source 1..1149: mol_type = other RNA; note = synthetic construct
atgaaagagttcgaaaacatagggtcaattctcaaggccatcgtgcaaaaatctatgtacaatgtgattggactgtctaacgccattgatctcgaaagagctctggaactggctcgggacccaaagaccgggtataggcgatttattatggagaagaaaagtggcggcaaaagacctattgatgctccgcacgatgacctcaagttcgtccaaaggatgatctataagaagatcctcttgaaggattttactccatcgaaaatatgccactctaccctggagcgttcaatcgtttccaacgcctatgcccatttaggtgtcccagccgatgttgtgcctaatccatcctacatcaccatcccgtggagagagccccagtccatacatttgatcgatctccagggtgcttttccaagcattaagaccgggcggatcaaggaaatttaccaggatattctgcacgatgagaacgccgcagagattcttactgagcttagtcaactgcggggaagccttcctcagggagcacctacttcccccctgttgtttaatttggcctgcagagaacttgaccgcgatctagaagaggaatttgcagacccaagactccctcttacacgttatgtggacgacatctcagtaacttccttggactcacgcgtgccccagaagaaacaaaaaatgctgcgcatgatcgtggaaaaacatgggtttaagatcaaggaggagaaggttgccaactgggatgtgagggacaagcctctgaacgtcaccggaattgcgttaaaccccgcaaaacgggcgatcttcctaccctacaaaacaagagagatatttaggctcttaatgttcaagagctataagacgctgtgtgaggctaatagcgagtggtttgagcaggagcgagacatcagcctgatgaagttcattacgcaggggaggcgccggtacaaacgagccttcggaaccatctgtggcgtggcgtctctggcattcatggtatatggtaaagacgaagcccccaaacgcacattcagttggttcgaaggctacgatggtgacgtcagcagtgctacattccaggcaatcctggacgacataaggaatggcgacctggtcggcgaaatttggggctacaatcagttttga

SEQ ID NO: 14430 - RNA, 1215 nt, unidentified
  source 1..1215: mol_type = other RNA; note = synthetic construct
atggcaaagaatcccgaatccattggctcgctgttagctaacctgtcagctaaggagccgagggggagtctcctgaccaatctgctggcaaagatcagtctgcacgaaacagccaagttaatcgggaccgacgagagatccctcttgagagctctgagactggccaaacggcccgacggctacaagcgaaagtacattcccaagaagaggggcgggttcagacctgtcgacgcaccacatgacgacttaaaatgggtgcaacggtgcctgcaccgcaacttcctcagacgccgccaccatccgtcatccatatgccatagcttcgttggaaaatgttatgatcctcaagcggagttcggggagaaatggagagcggggcgcagcatcgtttcaggtgcctatgagcatatttgtcctggcgaatggaggcatccaaggtcactgttcagcgtggacatgaaggatgcctttccaagtgtgacagagaaaagggtgagcgctatctataaagagctgtccgggaatgagctcgtggcaaaggtactcactaacctgagcgtgctcaacaactctctgcctcagggagccccaacttcccccacactgtttaatctagcttgcagggagttggatgcaaacctcgccgaggagtttggtttagatggtcgttttgtgattactcggtatgccgacgacgtgacgatcaccagtgtagagcgggaaatcaaaaccgccgaccgagaacgacttgtgaaagtggtcgagggccacggattcaaggttaatcgagaaaaggattgttactggcaggactggagacacgtcctgcgcgtcaccggcataaatttggaccctgagaagcggcgtcttttcctgcccaggtctgaactcgatcgtctgcgcctgttggcgtttcacagccttcgggtgcttgagaatgaatctgccgcttggcttgaaagtaagtccagattcgacgtcccagacttcctccggtcccttgacaaaagggctacaatggccttcggacgcttgggcggcattgttggattttgctctatggtatacgatgagcaggagtggccatcacggctcttcggatggcaccccgctctagccgaatggtctaaagatgattttcacacgctgttgcagataatcaaagaaggtgaactagcaaaccctgattctgatctgtttgattttagcccctga

SEQ ID NO: 14431 - RNA, 1266 nt, unidentified
  source 1..1266: mol_type = other RNA; note = synthetic construct
atgaacattaaaaagctgaggaaggaagacacaaatctgcagcagccatctttgggaatccagagcctcgtcgagaagaccttaggaaagctggcactcgaggagactgctaggttaattggggtggatgtttcggacttggtcaaggcactcgagatagctaaatcatctgacggctaccggcacaaaaagatcctgaaaaagcgcggaaaaggctataggcggatcgacgtacctcataaagatttaaaatgggtccaacgggcgtgccacattaatctcttgcttcgccactttaaacctactcccatctgccattccttcgtgggacggagattcgaaaaggactctcttcactggatttttggcaggtctgtcatcagcggagcctgggctcatctaggcgttcccccagacgaagaaccagaccccaagagcaattcaatcaattggagaaagccccgaagccagctggccatcgactttaaggatgcctttcccagtgtgtcccgcacacgtataaaggagatcctgcagaagctgctcgagcagacgggtaaatatcaggcaggtgcagacattatcgctgagatacttgttgacctcaccacctggaatggcgtcctcccacaaggggcccctacatcccctgtgctcttcaacctggcctgtcgagatctagatgaaattctgatcggggaattctctgatgaggagcaaaagagtcgcatcaagatcacaaggttctgcgatgatatatccgtgacgcgactgtcaaagaaaattggcctgaaaacccgaggtaaaattgagaggttgattcataagaacggcttccagatcaacgaagaaaaaactgtgcactggcaggactcccaccatgtgttgcgcattaactcaatcaatctggatcctatcaaccggcgtgtgttcctgccgcgggagactattgagagattccgctacctgctttatagatcttggcaggaacttgaagagtcattcagttggtggctggtgcttgggcgtgactccgataacaccataaagtattttctgaaccaagccgcgtatgggagaattgccgggatcgtaggttactgtagaatgatctacaaggaggatagcgaaatgccactcagactattttcctggaatccggacttgagcggctactgggaccaggagaggttcgagcaaatctttgctgatataagcaaaggaagtctgattcaggatctggaagaccacttacactacttttga

SEQ ID NO: 14432 - RNA, 1212 nt, unidentified
  source 1..1212: mol_type = other RNA; note = synthetic construct
atgcttcatcaggctatcggccatgtggccgacctcattggtttgcgcaagagggacgtaccgttcctgaagactgtttatgaacgggctctgaaagacccctacgcgtatgaacccatccttattcgaaaaaaacgtgggggctacaggcgtatcgatatacctaacaaaggactcaaatacgtgcagcggtgcatccaccaccaactcctggtcaggcgatacgagcccacccacatttgtcactcacatattcggaagacctatgacgtagctcaggagtatggagacaggtggttaccaggccggaccatcgtgagcaatgctttcgcccaccttggcgtccctcctgacgtcgatcctcacgaccaatacgatgacgaaaggataagatggcgcacaccatgctccctgtttgccatcgatctaaaagatgcctacccttctgttagcgaggacatggtgttcgacgtgtatggcgagttggctggtgacccgtggagtgccgagatactcacacgcctgtccgtgtggcatggctgtttaccccagggcgccccaacgagtccattgctgctgaactttgtccttcgagacttggacgcggcaatcaaaaaggagtttcgcccacagcacttctgtgtgactagatacgtggatgacgtagttctcacctcaaggcacaagaggatttcgttacggatccagaagcggcttattgacctggtggaagcatatgggttcaaggtgaacctggaaaagaactgttactggcaagctgatcggcatgtgctgagagttacatctgtcaatctatatcccgaagaacgcagagtggcactcagcaaaaccgttgtcgagcagtttcgctcactgctgtatgggttgtttacaggactaagggcgaatggatttctcctgcactccaatctcgtggcagacgccttctcccgagctctggattgcgaggatcctagagtagccgagatccatggcatgagatctaaacagtttcacaagatgatggggatcattggattctgccatcttgtgtatgggaacgagctgcccaagcgtctgagtgcatggggggacagaggtggtggagatgcaatggatgttgaatgggccatcgagatgattaaggatgggtacttcgatactgatgtgatagatgcctcttacgacgccagcggctaccgcgtcagatga

SEQ ID NO: 14433 - RNA, 1167 nt, unidentified
  source 1..1167: mol_type = other RNA; note = synthetic construct
atgagaaaggaggtgcgtcagatgtttcccaagagaatcggagccatcgtcccaggtgtaatgagggaagccgttctcccatacttagcccaacagctcgctatcaaggcagatatgctacgtgaagcgcttgaaatccgcgcacggcctatggtgcagggtgacctggagtctccctacaggcggtaccccaagaaaaagaagaccggaggcgttcgatggatcacagcaccacatgaaaccctgaaaaaggtccaggctgctatctataagcgcctgctccgcccacgctacaaaccaacaccaattgctcacgggtttattagaggacgggggatcgtaacgaacgccgctgtgcacatccaagggggcagagaacctcagagtgcattgaatattgatctccaggatgcctttccttctgtccgggcagagagagtggttaaactgttccgtaagctgaccggctccgaggagctggccttgactctgggatatctgactacttggaagaatgaacagggacagggcgcgattcctcaaggggctcccagcagccctattctgctaaactcagtgctgcaggagttcgacgccgagctccttgagctggcagggaagttcgggttggtggtgactaggtatgttgacgacatcacattgagcggacccgacgcccgaataccggataaagtctttacttatgtggctaggctggccaaaaagcacggtttcctccccaatatgaccaaattgcggtggcaacatgccaaccggaaccctattgaaataacaggcctccacctgataaaaccttgggtaggtgacttagaagtgaggcttccagctgctacacggcgcagatggaggggcatcctacacaacctggcagaggtgcccaccgacgcctttggcaagcctgaggtgggccttggggtgggaatcattggcgtcgccagacatgtccaggccgtcagttccaatgccgcgacccgaggccatattctgccgtacgaacttagagctccggcatgcgagttggccctcctggatagggttccctcaattgagacgttaagggaccccagagcgtggcgcaaattccagcagaaacaccaggagtcgatacgacggttcgaactggcctacgcagatcgccaatcctga

SEQ ID NO: 14434 - RNA, 1122 nt, unidentified
  source 1..1122: mol_type = other RNA; note = synthetic construct
atggaaacggtggtgccttacgtcgagcagctggagttcgacttccccggagttcctagacgcggaccaggacgcgtgtttgtggtaccagataatattaagcagaagatagagtgcgctagagattttttggtgggacgtctcagattgccttaccaggagatggccttcgctctgaccctgcccaatgcatgctggtatgagattactaagaaggtaggcgacaaacagcgcaccttctatgtatctagacggccattagctgagatgcagcgccgcatcgccacgtatctagaagattcttccaaatgggagcgatggtcgatgagaaaaaggggcagccttcatcggagcgagacagatttagcctccgctttccggcgaggcacaagcatcatcacaaatgcctggccccaccgggttaaccggagttcactgaccctggacctccgcgatgcttttgagtcaattaccagaagacacgtggaaaggtatttaacccgaatctttgctaacaacatcactcaccccgtccaaagccccgaagtgactgcctgggttcttagtcggcttgttacatgccgcggtaaactgcggcaaggccccccatcctctcctgcagtcttcaattgtatgctggaaaggctcgacgacgcgctggcagaagctaccggtgcaccgaaaagggacgtgatcatgcccgccatgtacttgggcatgagattccagcgttaccgggagctggatgcatctgataggaggtcaggggcgagttacgtcgcacctcgaggggtcctgtatacaaggtacgccgacgatctttgttttagccacccggacgagacatttccaatagccctggaggagatgatcagaaaggtggtggcttcccatggcttccgtattaatggggccaagactaggcatggacgatacgggatactggaatttccgggggtcgtggtcgcaaacggccatctcaggcctaagacccggctagtgcaagaaattctcgagggagtttcaattatgactgcccaggaacgcgccgggtatcgtgcgttcctgcaccagttcggcccatccggtagactcgaatgtttgagggtgtttgacaactga

SEQ ID NO: 14435 - RNA, 1053 nt, unidentified
  source 1..1053: mol_type = other RNA; note = synthetic construct
atggacacatcgaggggcatcgccgcaagagggcacgtagatgcatgcctcgcaggcctgaagatgtactccctagatccagatgttgtgcttgacgtccttctgcggcccaacgctcattggcagcgcgtcgtgaaggagaaacggggcaaacagagggtatgttactctccttccgatgacctgagaacgcttcaatggcgtctgatcaggattctggaccgcagcatcaagttccatcggggttattgccgaatctgggaccagcgttatgccttcaccatctctaagccccggttcccacagaccggatggtggaaagggtcttcaattgtcgccaacgctagggttcacaggcacagtaatagtgccttggtgtgtgacctgcggcacgccttccagagcatcaccacaaggcacatacaatcttttcttaacagaacccagccctttagaattcgaagaagaagggacgcttcctggacttacttccctgaatccttaatgtgggtggcctcacggctgttgacatactacgggaggctccgctatggagctccggcaagcccgattatgttcaattttatgatagaccgactggctgtagacctggccactgctgttaacgctcccctccatgtgaatgaggcggccctccgctccacgcaacgaattctcatgaccgtgtatggagacgatatttgttttagttgcaagagaggcgccgttccagagagcgtgctctggagaacagagacactggtgcgccaacatgggtttcgtatgaaccacgccaaaacactccgctcagggaatggagcgttactgttacctggagtggtcataagcgcacacgaagtgcgcccccgcgatacctacttggatccattggccaccgcaatccagggcggcgaacttactcaggatcaggctaacgggcatctaggtttcctgaagccttttaagaggccaggtcgacgggcgttgaaacggtggggtcctactctgtatgcccagctgcaggaaagagcaggcgtcactatcaatgagtga

SEQ ID NO: 14436 - RNA, 1005 nt, unidentified
  source 1..1005: mol_type = other RNA; note = synthetic construct
atgttcgtggaatccattatttggagtatggccgaaaacactaccccaagctttgataaagagctagtgagatatcggaataccatctcaaggttggttagtttagctgagcgggagaggtacctcaagccattctatgtcaagaaaaagagcggaggcaaacgacgcatagtgcccgctactaaggacctggtgtacgttcaaagcatacttgcatcttggttcgtcaaaacatttggtggcagcgctgattactgctatacgggcaaggggatcatccctgctatcaagccacatcagggtgccaaaacagcattggtggttgatctgaaagacgcatttgaccacgtcacaaaggagaagatttacaagctcctggagcgccggtttcgtaagatgtccaaagaagtcagacttctcatagcaaccctcctgacctacgagggcaccactcctcaaggatgtgttagtaccccttacgtatttaacgctgtggtggaccccatggacaaagacctgctggccatcctgggaaactttccactgagggcgtatacccgttacgcagataacatgtgcttctcgttcgataaaccggtaaatctgtgggccgtcgacagagccgttgccaagattatctcaatgcatgattttcaggtgtcttggtcagccggatttgaacatatgcccatctcctatcttggcactcacgtgtacgaagacagactggaactcgaccccgataaactggacgcctatgtgctcctcttaaatgaggctttgtccagccctacacccgaggtgtaccgcaaacagattctggggattctgacctgggtgtctcaggtgtataagacgactaacccagaaaagttgtccccggaagatagggcgaagctagcctatttcatcggtcttttccagcagtacttcgggaaggtacgcgggacacctgagttactggagcggcttgtcacatcattccacaattctcgaatgttctga

SEQ ID NO: 14437 - RNA, 1233 nt, unidentified
  source 1..1233: mol_type = other RNA; note = synthetic construct
atgacgaagattctgcagagtgcctgtaacccactgcagaccaaaggtgggctggccgctgcatactatctgcggaattttctgggctacaaggacagcgagcacaaaattaacttcctagagctccttaggagggccatttatcggaactctaacctctacagcactgccaggatcccgaagagaaacggcaagtacagaatacttaatatcccgtgccatgaactaaagatcgtccagcgcctgatcaacaagaccatcttgcagaaaactcgcgtcttaaaatgcacgtttgggttctacggagggagtggccttgaagccctgaaaaaagtggttaaacctgagcaggccattttttcagtagatatagtggacgccttttccaatacaaccgctcgggctgtgtatcacgtattccgacgactgaaattcgggcatttcgcctcttactatttgacctgtctcacaacctggctccatcccacaagatcgttctcacagactaaacgtcagagcgatcacgattttgcgcatgataggtccgacgagttgcacgcattcttatcattcgggggattcaattttgccggtaaggaagctaaattgcagcaaaatagctttgtgctgcctcagggagcgcctactagccccagattatttgacctgtgtttttggcagctggactacaatctggtcgtgagggcaatccacgttaagggatattacgtcagattcgctgacaatctctactttagtgcccccgagttctggcgggatggacagatagatattaccaagaacaacaagggcgctctactctttcactccccactgatttcatccatctatgatattatgcgagctggttatcggatatggattgaaccctttcaaaatatgccacgctacacccaaaagtggtaccagatctataagctccataaggccaggcttctgatgccagacgataaagactgcctgcctgctctcggctataacgttttccctgatggcacaataagaaataagcgtcgcttcgtgttgcgcatcaggatgtctgtgttcaacctgagaaaggcgctcgaatccggcaattatgaggacacatggcggatttaccagaaattgcagggtcaaatgcaattcgcaatccacgaccagctgccaccccgccttttaaagcaggcaactgacctgctttctcagatcaacagccagcaagcaatctga

SEQ ID NO: 14438 - RNA, 1131 nt, unidentified
  source 1..1131: mol_type = other RNA; note = synthetic construct
atgttgaagtcccgcactcatattaagaacccactgcttaaaatcagcgggaggaaggccgcttggtacctgttttcgactctcgactacccttttgacgacttcgaacgttttcgtaaaatcctatgggctgccatcgtgcggagcccatggttatactctaatatcgcaataccaaaacgtgacggaagcaagcggattcttgcaattcctcaccccgatttaatgaccatccagagagccatcaacaagaacttcctcgaactgtatcgacatcctaacgtctatggtttctccggaggcaacgctcgggaagctctgacagcgttggcccggtctaaccaggccatatttgcctctgatatcaaagacgcatttccctccactaccggaagagcggtcttcaatttctttaggacagaaaagttcggctactatactagctattacctgacctgcctcaccacctggtttaatcaacagaaaaagttcaaccttccccaagtaggtctgccgcagggggcacctactagtcccagactctttgacctgtgtttcatcaggtttgaccggagattcgcccggttgacaaagaatgccaatggggtgtacttccgctatgcagataatatcttcctgaccgccgaggagttttggccagagaggattaacattcagacgatgagggatggcggggtacgctggcaaagcccgatcattagtgctatctaccgaatacttaagagagggtacgagtttgaacattctcccgacaatgagatttggcacaatcaggagtatggcctgcacaagtcatactttgcaaggcagggacaaattcttcatgccctcggactaaacattaaagacgatcagttacacaacacacgagagttcaaactgagagtgcgcatgaccatcttcaatctgaagaaggctctcgaacaaaaggatgattttgagacgaaaatctggcctttgtatcacaagctggatggcatgcagaaattcttggtgaaagagacatcatccaagctgtgggaggaggctgaacaggccctgttccaggttgcgctcatacgctacagtggtcagggcggccgctacgttaaaaacatttcagaatattga

SEQ ID NO: 14439 - RNA, 1254 nt, unidentified
  source 1..1254: mol_type = other RNA; note = synthetic construct
atggctcatcagccaatttacaaccccctgggtaacccctggggtaaagcagctgctcactggttgcattggcagctggcccttgaagaggacgatattccttgggatatgtttgcaagcatcctttggcttgctatcgagcgggacccaggactttattatcgcaaacgcaagcagaagaagtcaggaggaacacgcactctgtgcgtgcccaacggagatttgaagaggattcaaaccaaaatcgatcagatagtgctcgccgctgaaccgagactgccttatgtgtatggctttggggggggctcagtggcccaagcattgcagccgcacctggagagggggtaccccatctttaccgccgacatcagggacgcattccccaatacgcatgacatggctgtctacaatgtgtttcggcgactaggctaccggaaaaacacagcctacctgctcacccgactctgtacgtggcctatcaatagccagtggcgagccgctctgccacaaggtgcacctagttcgcccaggctattcgatctatgctgtcgccccctggatgtgaaactgcaccagctcgctgcaaatgttgacgggtcctataccaggtatgctgataatctgttcttctctgcgagaagcttcagtgcccgccagtaccggccagacgaaaagaagagatacagaggttctgcctggccagaacctcagccgctgtggcagacagctccaggcgacgatgcggcagttatttcatggcacgccaccctcatttctgccatatatagacgctgcaccgacggctatgagttacctgaactccctcgtaaagtgtaccgtcaccactggtcctggctgagaaagtgttggatccacgtaaacccatctaacactatttccgatcggcttgagtaccagttacataagacatacctctggcatccaaaacagggacacgcgttcaaggcgctgggcttgcagataatcgacggacggctctgcaatagcaggaggtacaagcagagactgcggctgctgactcaccacgtcagctggctcctcgatcatcatcgtgattttgagactgaggtcgaccctgtttatctgcaacttaatgggctgctgcagtttgcagtaagagagacattgcccgcccctttgttaactgccgccgcagccttatgtcaacgcgtggaagacatcaggtattccggccccagtcacacccgagtccggcatattaacgcctactga

SEQ ID NO: 14440 - RNA, 1167 nt, unidentified
  source 1..1167: mol_type = other RNA; note = synthetic construct
atgaacgacaaaaaatccccgctcgagagacaaagtggccagatagccgcaaagtatctgttcaagaagttgaaataccccttcaaggactggcagaaattctgggatcttattcggctggctgtcgagcgagacaaaaatttatataggcagatctccctttctaaaagggggggcggcaaacgcgttatactcatcccttgtgaggagctgaagtacctccagcgcctgatttcccagagacttctggcagacatctcaggtcatcccaacgcctccgggttcagtgagggtagcatccgcgaggcccttctgccaattgtgcgggccaagcaacccattttctgcgcggacgtaaaggatgcctttcctgagactacattcggtgctgtgttcagcgctttccagcgatgtaagtatggatacaacagcagctacttcctgacatatctaacaacatggaggacgtaccagtcactcttttataattctgcccttccacagggggcaccaacctctcctagattgtttgatttgtgctttgaacccattgacaatgcgctggccaagtttgccgccaagatcgggggagtttacacccgttatgctgacaacatcttttttaccgcgcctaccttctggcctgctcggaaaagttgcagaaaagtggaaggggaaaccatcgtcaaagataaacatggatttgaaacgtactacccttacaagcgtaagataagcaccatccccgaaggaaaggctgatatcgacaaaagtgattcgggcgctttaaactggcactcaccagtgatttctgcaatttaccagattgtgcacactaagggcaaaggaacttactatcagctacacaaatcctacctatgtgacaagggccaactgttgcacgccctgggcctgaatctgatcaacggccagctccataatacaagggaatttaagaggcacctccggctgaccatttttaacctgcaaaagagcctgtccgcacaggacgatttcggtaataaaatctggccgttatatcagaagctgaatgggatgatgcagttcgccatcaaggagactttgccagtgtctctggtccaacagtgggaagagctcgatctcgcaatatatcaaattcgctatcccagaacaatcggaacttga

SEQ ID NO: 14441 - RNA, 1101 nt, unidentified
  source 1..1101: mol_type = other RNA; note = synthetic construct
atgtgggaaaataagcagaccgggtctattcggcacgagtactacgaaccggaggagaatgtcgccgccttagtatggcttagtaaggagctggggtacaaaattgtcggcgaggatgtgatttactctctattggtccagctcagggtggacaagcctgagcagaaccccctgtaccacaccattctcaaaagaaagaatgacggaactatcagaaagctatatagccccctcgatgaattaaaagaggtgcagtaccggatcaagaggcgcatcctgagctcctaccaggtgtcagacaacgccttcggatactccgggggaagtgtctttgacactcttcagccgcacctgcctacagacggtgagcaaagaattatgttccaggccgatatcaagaacgctttcccatccgtatctggcgaaaatgtgtttcttgctctctatggtctgccttcgagcgaatcttatgaacattatcgcgagaagggctacctgtcctggcatgttgccgctatgctgacggagttgctgaccatttatgatggatggagcggtttcctgccacaaggtgctccaacatcccctaaactgttcgacctcgtgtttctcggcattgacagaaacctttcccacttggcatgcaacgttggcggcgtttacacacgtttcgcggacaacatatacttttctatgaaaggggagtttttccccgaggtcatctcccgtgccataatccgaacaatccaagagtgtcgcagtcgagacgattatctgttcgatgcacggagattttattgcaaaaaggtaaaggtgaggcccctgaacgttgaatcattgagggcattgggcctcaacattataaacggggaaatccacaatacccgcgagtttaaactttcaatccggaagagcatacaccatatcaattggctcctggcaaattcagatacccccgagtatagcgccaaactggaacatgccatcaatgtgctaaaaggacagatgtcattcgcggtggaggaaacccttccagaagctctgctgcaggactattacagcttaagtactactctggatgggtctgtgagtacgatttga

SEQ ID NO: 14442 - RNA, 1116 nt, unidentified
  source 1..1116: mol_type = other RNA; note = synthetic construct
atggtgagccgcatatttagcccatgccccgacatcgtttcggataacgaaataccagccattatctggctgagtaagaccttagggaaaccccaggacgatgggtccgtcctggaaattttaaaacgaatccggcagggcgagacactgtatgaggaggggttcgttctgaagaggaatggcaagttgcgcaaaattcttaaaccagtcccggaactcaaaaagatccaacgcgagattaacaggagagtactgtccgacctaatcgtgcaccctaatgtctctggattctctggcggtcagctgcacgatgccattcggcctcatctgaacgcaaagagcattttctgtaccgacatcaaggatgcctttccctcagtgacatacaatgacgtctttcgatgcctcactaagggacgagaatacgagttgacttatgatattagcgattcttactacgtgtatgacgaagaatgggacgacttctttccctgtattataggcagaaaacgtttcaagatactgaaccatggatttctgtcatggtacgctgctcagattgttaccgaaatcgctacagccaaggacgcgtacggaagactgagactggcacagggattccctacgtcccctcgcctctttgatgcccagatggaaccaatcgatatcaaactcactcatcttgcacaaaatgtcgaaggggtgtataccaggttcgctgacaatattcacttctcaatgcaagaggaggagtttcccggggaggtggcacgtgccatactcaagactattgagggaaggggtaggaacctatggagtaacaaatacgagtgccacaaaacacggagtttcaaaaccgatggccaggctgtgaggatcttaggcttgaacatcattgatggcaagatacataatacgagagcgtttaagcgggccgtgagactgtccatccaccacgttaagtggttccttgagcgcggtatcatcgacaccgaggagtttgaacatgcctatcggaagctgaatggccagatggggtttgcagtgccggagacattccctgtaaaactccttgacgattacagccagatcaaaaagacttataaggacttgtga

SEQ ID NO: 14443 - RNA, 1227 nt, unidentified
  source 1..1227: mol_type = other RNA; note = synthetic construct
atgggtatttacaaagaaatcgtgaaagaccttgtaattgattacaaaaagcgaaatccggactggacagaatatgattttagcgagcacctggtcctccttacgtaccgggccgggaacaatgctgtcctgcccgatcctttggcagacagcgaggaggcctggcaagcaacactgaacagtgaggtccctgtgaaaaacgatcctgtcgagacttttctctcttccttcaggctaaatcaagacggagatgagcggattatcaaaatcgttgagcggtcaacattttactggctgggtaaaatcttccgcatgcacttcctggaccttatgaatctggttgagaaaatccgcgttaagggctggtccaacttttatagactggagtggcaggataaaaaggggggaggcttccgccagttgcagatccctaaccgacaattgatgggaattcagactaagatcaatgaaaagctcctccgggatttacccaggtacccccaggccttctgtttctctggggggagggtgatcgatgcccttaggccacatttgaagttcggctctcttctgaaactggacattaaaaaggcttttccctcaataaccgcttatgacgtgcgcagaggactgacctttggccgtaagatcaagcccgtcgaaaagctccagaacattgaagactacggtcacttctcctggtatctagctaaaattatctgcgacctgtgcgtgacaagctccttgccacagggcgctccaacgagcgggaggttgttcgatctcgcattttaccctcttgacgtggaactctccaaacttctgaaggcggcgggaggaaattatactcgattcgcagacaacctcttcttttcagtatctgaacggttcttcccaagtgagctgaagaacagcattaagatcatcataaccggcgagaagaggaactttctaaagctgagataccacaagctctggataaccaataaaagatatgtggccctgcgcgccctcggcctgaatactctgaatgggcgtctgcggaacaccaaggcctttaagagtcgtttacgcaaagccatgcatcataaacagagactgtcggaattgggcctagacaccgaggccgctcagcaaaagataggcgggttaatgggttttgcagtgaaggaaactttaccgaacaagctgctgaagaagacagagcagattaaaaaagatagatga

SEQ ID NO: 14444 - RNA, 1089 nt, unidentified
  source 1..1089: mol_type = other RNA; note = synthetic construct
atggacagaatcccctggagtgagagcgacatcgaattcgccttaagcctcggaagggacacagaagagagggaggccaacattgaacagtacacgtccgaatggatgaacgagaggactgagaggattcgtgggcgggaaaccgcagcttttctttggttggcagctaggattggcatgaaacctaaccgcttcctgttcgccgtcgcagggtttcggtcaggctcatttggctatacaacacacttcgtgactaagagagacggaaaaggcaagcgcaaaattaccgccccccacaaggtactcaaggcagtccagcgtaaaatcgcccaggagctgttctgggatcacccaagatcccctcattcttttggcttcctgggcggaagctcagccgaagccctgcttccacatgcgaaaaatgctagcctgctgatggtggatgttacaaatgcgttcccgtccatcgagcgggacgtcatattccggtggttccgcaagcgcgattatagttggagagtgtctggtattttagccgatttggctacctttgagggaagactcactcaagggtcccctctctctccgcggatcttcgaactgatgtttgaatggatagacgagaggctgagcagactggctaggagggttggggggacgtacactcgctatgcggataatgtgttttttagtatccccggtgcacacatggataaaaagctcgtgtggaccgtgcttaagaaaatttggcggatggaccttatctgccaagtccctcgggacaagagataccacccaaccttcgatacccacaagctcagggtacgaactctaccaggcaatgctgttcatacactcggactggtcttgcgggacggggaggtgcacaacacccgagattttaaacgcactctacgtaagagaatccatcatgtgagatatctgctggagaactcgcgcgagacaggcgttattttgtccgcctggacaatgttgtgtggaacgtactcttacgcccgaaaagaaaccctgccccccaagctgatacaggaggtggaagagcttcgaggtcgaatccaccagttatga

SEQ ID NO: 14445 - RNA, 1098 nt, unidentified
  source 1..1098: mol_type = other RNA; note = synthetic construct
atgattaataaccaagagttcgggtatgatccggagttcatgcttgcttttgtgcgcgaattggaggagaaacgcatagagcggggagatcagctgaggtttgaactggaggaggagaagcggtacattcgtaaaaaacagctgtacgctctgctctggttggcgcgccggatcgaagtgaaacccgagaagatcattgagctcttcctcgccatccaggagaagaaaaagatccacaatgtgtactttaagaacaaatcaggcggcggtaagcgaaaaatcatcgctcctataaaggagctgaaatatctacagaagcgcatttctacagaaatactgaagagatactccagagggtcagaaagctgctcctttgggtttatcggcggatccaccgcccaagccttacaaccccacctggaaagcggttgtctcttaatgttcgacattcgcgacgccttccccagcgtaaagcaccggcatattctggatctgtttagggggctagggttttcttggtacgtcgcttcgttcttagcagatgttgccacttatgaaggttgtctggctcagggaagcccaatgagtccaagaatcttcgaactcatctgcgcaaactatatcgaccggcctcttgagaaaatcgccagaaagaacgaagggatttatacacggtacgccgacaatatttttttttcagtgctgggcgatggcttcgacgaaagattgaaacgagagatcttccgtaatatctgtcctccacgtagttccaaccttaaatctccatactgccctaagtttcagactcacgaattcagggttaagaaactcgcgggcaacgccatacatgcgctgggactggtgattcacgatgaaaatgtccacaacaagagggagttcaagcgaaggtttcgcaaagctatccatcatgcaaagtggtgcctgaagaacaattatgacctgttgcccgaagcctggggaaaactcagaggcctattcagttatgcacagaaggataccttgccggcaaaattgaggtctgactacgagctgcttaaggacgagattctcaatctgggtattgaccttacgatatga

SEQ ID NO: 14446 - RNA, 1182 nt, unidentified
  source 1..1182: mol_type = other RNA; note = synthetic construct
atggaagattgtgaaggatttagtgatgaggagttggacgacgtggagtattcggttcagctggcagcagagaatgaggagtttgaatggaggttgcaacgagagattcagcggaagagaaaggaaattccagccttggtgtggctggcgcaccagatgaagatcgccccggacaacctcgacactgttcttaatatggtaaggaacgatcagtccccctataggatgatcacactggataaacctgatggaggtaaacggcggatcttcatccctatagaccctctcaaacggatccaaaggaaaatagtgaaatgcattttgtccgactttcaaactgggccaaactgctacggattctcaggtgggtccatcgtagaagccatagaaccccatctccaggcaggcaccattttatatgtcgacatccgcgacgcttttagctctagttccgccgagatggttatgagctaccttacagaaggaagggtccccacattcagatacgattacaatgggaagtcatggccttattgctatgacgaagatggcgagagaggcctccactacgggtctactaggcgactcgtgttcgaaggtatgctgagagaaggccgcatgtcttggagtgctgctcgcataatcgtggatctgacgacatacccagtcattggatctacgtgtgtcctgcctcaaggagctcctaccagcccctggctgttcgacatggtgtgtaagaaactggatgagaagctaaccgcatttgcgcagaaagttggcgggaagtatactcgttacgccgataacatttttttctcaatggaccaggatgaattcccaaacccggtcaagaatgccgtactgcgcatgatccggatgtatggccgtttccggccccacaaaattcgagtgcggagaatgactaagggcgctgtgaaactgcttggcctaaatgtgattgaggggcagatccataatacacgcgagttcaagaggcgcctcagattagccatccatcacgtggagtggtttctgaacaatcgactgaaggacaccccagaattcgacaccgcatggcacaaacttcagggtctgatggcctttgctagaatcgataccttaccacccaagctcctggagagctactacgagcttgaggaccgtatttttaagataaactga

SEQ ID NO: 14447 - RNA, 1089 nt, unidentified
  source 1..1089: mol_type = other RNA; note = synthetic construct
atgaactgggaggacgaactgtccgatcgctttttaagcaatggccatcagttgacgatgaaagagctggaagagcaccgcttgcaggacaggatcaagaaatctcggcgacgaattgattatcggaagaaaagtttcttctggctggggcataaactcgagctgccacactggctgaacctgtccgagatgctccagcgtattgatgtcgaaggatcagcctatttatacaaagaaccccagataattccgaaaccagaaggtggtacacggatcattcttagccctcaggctgacctgaagctagttcagacccggatcaataggctgttgctaaagaccttccccagacgccctgagacattcggctacatggggggcagctgtttggaactcgcccaaagacacctgggtatggcctccaccctcaagtttgatatcaaggatgcgttctttcaagtaccttggacaaatgtgcgcaagtccgtgaagggcttcagggggatagcacccgggttttcgggtagtgtatctcattggatcgctaagctgtgcacctactctccaactcccgaacacattaggaaccagtttggactctggaggggagccactagttttttgccccaaggggcgccgacaagcccaatatgctttcatctggcttgtgggcctcttgacgacgagatgactaaacttgcaaagaggttcggaggagtctggtcacgctatgctgacaattactacttttctatgccaacacctcagatctcaaacaagcttgaggagatcgttgtgtgtgaagcccggacgaagggattcaagattcacaaagtgagaagagtcaaacagggcgagttatgcagaatcctcggctacaacctgctagacggacgaatagccaatactcgtgattttaaccgtaacttccgcggcgcactttacgtgctcaggaccaaactggaccgagggctcgactatcgggatgcatatagcagagtgaagggcttcatgggcatggccattaatgttcccgagaatctgagactggagtatgattactgcaaaaacaagatcgaaaccatctga

SEQ ID NO: 14448 - RNA, 984 nt, unidentified
  source 1..984: mol_type = other RNA; note = synthetic construct
atgagatctatagaacctgtaatcttctccagcggagagggaagatttccagcagaggggctcgaagtcgactataatcgttttggcttcaaccctctggtgtatctcggtttccttataggcattccaacccgatggatcgattacgttattaagattggggctgacaatttttacactgaggtgcggatccccaaaaaaggcggaggagtgcgggtactgcaggtcccactggatcccctgatgggcattcagcgccgcatcctgaggaaggtgctgtctcaattggagcccaaatcatcctgccacggctttgtcaccggccggtcgatcataacaaacgcgcaggtgcatgtcggttccacgcatatgctggttctggatcttgaaagcgccttcgaccaagggttatcaagccgaatcttcagggagctgtggggagaacgcgtcggcgaaagaagactggggttcttagtggcctcccttattacccaactgtgtactgtctacagcggcgacatcggggagagatatggctttaggcatctgccgcagggtgccccaacatctcctgctctcttcaaccttgcttgcaggcctctcgatggccggctcgaccactttgtgtggcggatcgggggtgtgtataccaggtacgcagataatctggcatttagtgtgcctagacagctgactccgaaggaagagcatatcattcggaagattgtagacgggagtggattccgcgttaatgacgctaaaacaagattaatgaggcagtcaggccacagtatcctacgcctcccaggagtggccattaacaacgggcgtatcattttgcccaagcggaaacgaaagcagttgagggcagccatatacttggcggcccttcacggagagacagatcgcctcaggggtctaatcggcttcgttgaacaggtgtacgggcccgaggttccccgacagatcattggatctcactga

SEQ ID NO: 14449 - RNA, 1017 nt, unidentified
  source 1..1017: mol_type = other RNA; note = synthetic construct
atgcctacactcactggacgtcagtacgccgcaggccgaaaacttgctaggcgcctagatttacctcccgatcagctgttcctcgtgcttgaatatggtgcagccgctttttacgggagttacgcacagcctaaatccggagggggcacccgtatcattcacgtgccccacgaaccattggtaacaattcagcaagccatccttaagaggtacttctcctgtctgcctgtcagcccaattgctcatggctgtgttgcgggtcggggcattgaatccaacgccttcccacacagaaaggctaggtctatggtgggctttgatctcaaggacgcgtataaccaggcctcttttacccggagcttcatccagacctaccaccaccattatacaacgtcaaacggagaggtgatcgagagatggtgctcacagcggaagcagccttgggacattttgcccatggagctcgcggttctggagatcgtctcagatcttgtcgacatttatagcgattataaggaggtgctgccgcattataaactggtactgccccaaggagcccctacttcgcccgcactctttaacttcgcctgccagcgaatggacgctaggctggagcatctggcaagtaacgtgggcggagtggtgactcgcttcgtggacaatatagtcttctcttgggaaaatgatgaagttgaccgccccgtatatagcgccatccggcggattatcgagaagtccgggtttaaggtcaatgaaaggaagaccgtggccataagaaatggcaacagaaacggggtgccactgcgctttccaggcgttcatatcatagacggagatttgtacataccccggaaaaagttgagacacctgagaatggccctgcactgcgctgggaaagcccacaatgacgcactctaccaggggatcaaaggctacgccctacaggtcgaggctcaaatgccgccgcaattacgaggtgtgtacggtaaagcacgcgctgacaatccaaggatctga

SEQ ID NO: 14450 - RNA, 966 nt, unidentified
  source 1..966: mol_type = other RNA; note = synthetic construct
atgtctctaacactggagattggccttcaagataataaacccgcaattaagtcctataagactgaactgagccaatatctgtccgacttgactcaccctctagaagtcctcgagatatcacaccgccgcaaggaacttaccgatatcttattagatttgacggaaaccacacagctgagtcttctgtgtgatgagtcagaaactctcgatcatttgttcgatgggctcctgcagctccgaaaggagaagaggccgctctacaagcggttccagaaagagatcaacggcaaaacgcgggacctggcagtccctcagaaacccctggacctcttcctaagaaattacgctggacccataatcaatcaggcagaatgccacgctcaagctcatggaggagaaaacaactggtctttgaccgagagcattaaaacacacctgcccataggtattgctctgtcctttgacctgtcccaggcgtttaagaacacccacctccagtacgtattcgacttttactacagcctgatctacaagaaaaccagagacaagaaaacttctactgacctcgcgggctttttagccacagtgtccactgtgtactacagggatggtgggtatgcacttccacagggcagcaatatagccacaaaactgtttaaccgtctgctgtatccaatcgacgagagcctgtcaaactacgccaagaaccgaaacttaacgtatacccggtggatcgacgattttatcctggccagtaaagacagagacaagaccaataaggagcttattgaggccactaatattgttcagccatacttccctctgtctgaaaagaaaacattccttcagagggataagcctgtgtatctcttggggcagaaaatcgtggattgctggatcacaaaggccacaaccaaggagattcaatcgaaaaatccaatgaagagtaccacccattatttgtga

SEQ ID NO: 14451 - RNA, 954 nt, unidentified
  source 1..954: mol_type = other RNA; note = synthetic construct
atggacctcgctgtttgtgatcagtacaagaaggtgaagctgcaagttcagatccataccaaggaacttactgactatttgcactccattgagcattcactccagttgctggaagacactaataagcgcaaggatgtaactagcatcctcctggagttcactaaaacaagccagctttccctgctgggcgatgaagcaaaaaccctggacgtggtgctagaaaacctattagatctgagacgggccaaacggcccctctataagaggttcaaaattaaggtgggagagaaaatccgggacatatcagtcccacaaaaatctctcgaactgttccttaagtattacgttagccccctgattgaccacgccaaatgtcacgcacagagtcatggcggggaggtgggatgcacacctaagtactccattaagtcgatcctgcctgtcgagtttgtactcagctttgaccttaaggatgcttataaaaacatcgacctgcagtacatattcgacttttactatgacctgattttcgagaaaacgaaggatgtggagaagagcaagcagacggccggctttttggcgggtgtgtctacagtctactatgcagacagaggctatgccctgccccaagggtcacctatctgcagtaaattatttaaccgcgtcctgctgccaattgataatctcttgtacaaatactccctcgagattggccttgattacgtgaggtgggttgacgattttatatttagtagctccgattgcgggctgacactagataagttcgtgaaaaccttggacatcgtgagaaattacttcccgatctctgagaataagacctacttccagcgaaaacacccagtatatttgttaggacacaagatcgtcggtaccgatatatcagaagctaccactgaggaactcgaaacaaggcgtcagatcaacctgtcttga

SEQ ID NO: 14452 - RNA, 1089 nt, unidentified
  source 1..1089: mol_type = other RNA; note = synthetic construct
atgcccgccgttctggaagaggtgccgattaatgactcccctctggtgctgggcgtcccaggacactattacagcttcttcggtggaccgttattcctcggaattcatgacgataaactcagggagcactacgaaaagattaagataccactcaacatactgagggatgatgagaaacgtcgcaacttggctgagctcttatcctcattaaatccaaaaccgggccttttttccggagagtctgacctagaggagctgttcccactgatcctggagcagaagcacttgtaccaaatctggaaacagaaggtgaatggcaaagagagaagtttttacgtacctcagaaggcctttaagaccctacttacgaactacgtgctcccctttgttaaagcagtacccgcgcatcccagttgtcatggcggagagaaaggctggacagtgaaaaaaagcctcgaatcacatcttcccgtcgtgtcaagcctgacttttgatatgtcagctgcctaccatcaggccaccatgaattacgtttttgagttcttttacgactctcttgaaggccgttgcaagaccgaggagcaacgacgggacgctgcagtgttcctgtccgccgtgtgtaccattcgcaaggactacgacgaaagaagagaagaatgcttcgaggcatctttgcccgaggggagcgccgttagcagtgctgtctttaaccgaatgctgctccctattgacgaagaattctctcggttcgccgagaagaagggtatcaagtattccaggtggatcgacgactttgtcttcacctcgcctaagaaacgcaagttcaaccacttcgagtatgtcatgcggaaggcacaggaatcctttacactggcacctagaaaagtgtttttcacttatgagggggtgtcttatctgttgggccacaagatcgcgtataatgaaatcgaaaagatcagtagggaggaattcgagaaacagcggggagaaccatatacaggggggatgctgagcgatacacacccttgggattgcatgtacgaaggttatgaggaaccaacttgtgatgggaacgatatacccttttga

SEQ ID NO: 14453 - RNA, 1218 nt, unidentified
  source 1..1218: mol_type = other RNA; note = synthetic construct
atggaggaccgtatgtacgccccaagcggtagacggttccgcatctttgttgactgtatgagcatggggagccggctggacgtgatcccttcagagaatccagatctagaaattgacactgatggaacgccaactattttcctaagttctgtgccattggtgccgggggcttattttaccggcccgtggctgccgatgtcttatgccgatgagctagtcaaatatttttctgagacaaggaatcccctggaggtgctggagagcaagaaggaaataatactcaagaccctcctggaattactccctttggacaatcaactttctatgttggacaataaacaggagaggctggaggtgttgttagatgacttgctggccctcaaaggcgaacgaaagcatctgtaccagcgctggtcacaaaggatcaacgggaaagttagggacatttccattccccaggattccctcgaacatttactcatcgagtacgtaaaacccatcatcatggaggctccttgtcacagccagtgccatggaggcgaacagggattctcaccaaagaagtcgctgtcccgacacctgcccctgggtactgtgctgagctttgacctggccaacgctttcaagaacacacacattcagtatgtgtttgatttctactacacgctcttcgagaataaaatcgagaaccgcgaaatacggcgtgacatcgcaggctttctgacatccatcagcactgtatactatagtgatacccaaatctctgcgctgcctgtgggcagtcctatttccatctgcctcttcaaccggctgttttatccaattgacgaagtgctgcatatctgcgcccttaagaaggggttaagatataccagatgggtcgatgatatcaccatctcagcaaaagaaacaaaccggaatcctgaaaagatatgtggtgccatttcgatggttaggcgcgaatttcccatagcagttaataaggtgttctttcagcagaatgtccccgagttctaccttcttgggcacaagattatcggcaacagaatcaccaagatgaacaaagagaagtccaaagacaaattggtcccccttgatcccgagtgcattgctacagagagagagatagagtggattcacgaggtctacatgggcgagattcctcctaaccagggagaatgtagtctcgaaggacttgaagaagatctgccattctga

SEQ ID NO: 14454 - RNA, 1164 nt, unidentified
  source 1..1164: mol_type = other RNA; note = synthetic construct
atgtccatagaggccgagatcaagtcgtgcaatgacgtcttcgtggaggggagtttttataagcacaaatacgaggatgagacatctgcaatactgctcaaagaaaggctgggcattcccgttgcctatttccgaggcccctggctgccgatgttttatattaacgagtgtatggagtactccttctctcttgattacccctcccagatcttggaaataccaaagcgcagaaaacaaattgtggatgctatgctcgagcttcgctccgcccagcagcaagcatcacttttcaacatcgacgagaagcaggacttggaaagcctcctggacaggctcctcattctgaagaataataataggcccttatacaagcggtggacccagaatattgacgggaaaaagagagaactgtccgttccccagaaggccctggacgtgctgctgaaaaactacgtgcacgacattatcatgctcgctccatgtcacccacagtgccatggaggtgagaaaggttggtctgtaaaaaaatctctggcgacccatacacctctgggaactgtgttgtccttcgacctcgctaacgccttcaagaacgttgacatccaatacgtgttcgacttctattaccggctgtttgagagcaaaataagcgatcctgaaaacaggagagacactgcggggtttctgaccactttaagcacagtctactataaagacaaggacagctttgcactacctcaaggcagtcccgtgagtatccctctgttcaaccgccttttttacccgatcgataagctaatgcaggagtcagctaccaagcgcaacctgaggtatacccggtggatcgatgacctcattatttctgcaaaagagagcaaccgtaatcgaaagaagttttttggctcattatcaatcgtaagagaagatttccctgtcaatttgaataagacattctttcagcagaacctaccagaatactttttgctgggtcataagatcatcggcaaccttgtcatcaaggtgagtaaggatgaagaaaaaaatcgtggggagcagattgacccagattgcttcgccacgcactatgagcgggaacacctgtggatcgaagattattacgacggcgatgagcctggagattttggagaaattaaagatttctga

SEQ ID NO: 14455 - RNA, 933 nt, unidentified
  source 1..933: mol_type = other RNA; note = synthetic construct
atgcctgtgtacgaaagagaatttttcgactatgtcgagtcaaatcttcaccctaccggatcagtcttagccaatccctgccgccgaggaagtttgagacgtctgttgagcccggggacacaggaggacctgtttggagatcctctagaggtgatcctcgaacggctgagtggcgatattgtcaatcggaaaggtgggtatatgcgctggagggaaaagatcggagagaaagagaggatgctcagcgttccttccaagacactgtggaaatttctcgaagattatctggaacccttcattgaaaaacagcgtgttcacgggagctgccatgggggcatcaagggctggtccccaaagtcttccttagaatctcacctgccaatcgtgactgccctgtcttttgatatggagagcgcattccagaacatgcccgcccgaaaggtcttcgacttcttctactgttcactcaagggtattgacaactacgaggaaaggcgcgacattgcaggattcctgacgttcatctccaccgtgagatatgatcaacaacgcggcttgcctcagggctccccgatctctcaggctatattcaatcggttgatgctggaggtagatgagactatgttttgggccgctaccgagcgggggatgacatacagtcggtgggtggacgatttcaccgtgtcaagcccagacagacgggatgtcagagagtttctcggcgccgtaaatctgctcgcggagagatttcccgtggctcgtgacaaagtgtactttcaggagggggaacccgtgtaccttctaggtcataagcttgttggcggtagggttctgaaaaactcgcgcgaagagaggcttcgcaacaagactccaccactggactactataagtggctgagcaacaggcgagcatttgagccctggataaactga

SEQ ID NO: 14456 - RNA, 924 nt, unidentified
  source 1..924: mol_type = other RNA; note = synthetic construct
atgaatcccaaggtggataggctgaatgagtattgtcgacgctttggtccggggttccgggtcctggatgatgttcgcaatgtgctcgttgattttctcgctggcctggacaggcagttggacctctttgaaagtcccgagcagcgggcccttagctccttagaagctctaagggtccacgacggaagcctttacaatcgctggtcttttagcgataaccgaaaacgtagagagttgtcagtaccttgtgagccattgaaggtatttatagatgactacctcatccctctaatcaagcggaccaaagtccacgagtgttgtcatggcgcggagcctggctggtcgccaagaagatccctggaagatcacctgccctgctattccgtgttgagcttcgatctcaaaagtgcattcaataactttacgatcgccgaagtcttcgatttttactattctctcgacctggaaggcctagaggaggacgaaaaaatcgccgtggccggattcctcagtatgatttcatcaagcctggtggatggacgacgcgttctgccgacaggagcttctcattctccccttctgttcaaccgggggttgttagaacttgacgatgagttatacgaagggtgctccagaaaggggttcaactacaccagatggctggacgacattacaattagctcacagggtaaagtgtgcatcgaagagctgctgggcgcagtggagctgactgaacgttatttccctgtcgctccaaacaagatattcttccaaaaggcagacgagcccatttatctgctgggccatgttatctatctcggtagggtgtgcaagaactcccggactgagcgcgacgcccacaaggtgaaaccacttgactacgatgagtggtttggagacagggggtacgagggctgggaatga

SEQ ID NO: 14457 - RNA, 954 nt, unidentified
  source 1..954: mol_type = other RNA; note = synthetic construct
atgcttaacgaagtggtggtgaatttaagagacgaatccctcattgaagctgccggcgcggtgatcgatgccgctataacccctcgcaaccgtatctctaccttgtttcctgaggtagacgaggcctatcggccagcaaatctgtggcgagatgtcttagaaatgctggaccagggaagaagcctatacagtcgcttccagaaagccgacagcaatggcagggtaagggacatctcagttccccaagcagcctttctcgagtttgtgaataggtgtctgatccccctggtgaaatccgtgccaagccacccggcatcccatggaattgagaagggctggtccgctgaaagatccgtgaagacacacgttcctatacgtaccgcatttagcatggatatctcggatgccatacctggcgtgggtattgacaaagtttatgatttctactacgctctgctagaagattcaaagttcgggctgactgagcgggaaagagctggcgtggctggcaacttggcctacctgtcaacggtgcactatgcctctcgagggactagagggctggctgttgggtctggcctcagcaacactcttttcaataagctgttcatgggtattgacgtcgcaattcaagagggttgcaatcggaggggatttaggtacagtagatatctggacgacgtcaccgtaacaagtgaaggcgatgagtcaaacgaggcattcctggggatccatcccgttgtggcggcccatggatttcgcattagcccacgcaaaacattcgtgcagaaggcctctgagggtgacatctacctcctcgggcaggttgtcgtcaacggacgggcggtcatgaagaattccagggagatccgagaggccaacaagaaaggccggcttgagcccgagtacattgaacgggtcttgagctctggagattatagtcgctggatctga

SEQ ID NO: 14458 - RNA, 939 nt, unidentified
  source 1..939: mol_type = other RNA; note = synthetic construct
atgatcatcgaacagcaaagcagcattcacattacacagtatctgaatcgtattatggaagaggaccacaccccttcctaccagaggatctggatcgataaatatcatggcaccaccatattcaatccacagcaaatagcggaactaactgtaaagcaaaaggaagagccgcgccgagcggaccagagatatgtccggactttgggtcctgatccaaaaaccaaacagtggtgtcagactcttaatgatctgttgctccaatcccgggagccacaccccaattcccatggcttggaaaaaggccggaacactagtacatacatagagccccatagaactcaaaagaaggttttgagtgtctcgctctacaacgccttctcttcagttgggaaaaaaagggtgacatctatcgccaggcacctgttaggaattgaggggaacgctgccacattctttggcgagattgctaccaaacacggaaaactgaacctgggcaaccctctggctccccagctgctgaatatccaggcctataaaatggaccgctatctcacagacttcgtgagaaagtacggcctagaatactccagatttctcgacgagcttacattttctagcgcatactttatacagaccgagactatcgcaaaaatcaagagaattatctctcggtgcgggtggatgatcgataatgaaaccgtgaacatccagagcggtaatcatttcattattgccgggcatgtagtcgtgcctcgcgagggtgtggtgcgagagaagaaggagcacaggaaggaagcaacgaacacgataccaagtatcaaccagtcacacacaaaccaggctaataaggccctgaagacccttaccaaccccagcgatcggctgtcacgtgagaagggactcattaggaatctgaagggattacttaaccgcaagtga

SEQ ID NO: 14459 - RNA, 1278 nt, unidentified
  source 1..1278: mol_type = other RNA; note = synthetic construct
atgagtaggaaacaaaataaggtgagtaactcacacaataagtcgtggtccaactaccggcaagtttcatacatcaaaacatccgttgtccgccagatcggggtcgaggagctgaaacgaataaacaagcgcatcttcgtgctgatgaagcggagcgagggcttttttaaagaagaaaaggcccgaatgctggtggtaaaacaagcaaacggatacttccgtggccagaaggtgattagtcaggcagatcaacgcgctcttaaggcgactggcggtaagtatcgtgaggtcaccttcctcaaggacaaggcaacccgcaagatgctaaggaaagtcgctaagctcatcgatattccgcacgccgatcaggtgggttttactagaaagcgcagtatttgggatgcagctgcccgcttaggcgacgccaaatctatcgttaacatagacctcgaaaacgcatttaatgctattccagagcaggccgtctatttgattcttcggcgtgtgttcgacctgaacaaaaagcacgccagacagctaactaacgctattacagacggaggatacctgtatcagggaagccctttagctccccttattttcaatttgtggacaagaccaatcatggactccgtacggggagccggctttgatatcgtggcgtacgctgacgatctgacaatcggttctgactacggggctatcagccataaaatggttagggtgttcattaagtggataaggcagttcaatatgaacgtgaacatggccaaggtgaagttctacaacataaaaaaggcctacaaagagactgtgggtttgaagtccatccgctccggaggggggatactcacaacccctgtgaagtttaggaaaggcctgagaaagctcaggtacctgacacacctgtataccgttaatggcgtgacgcataccagacgcgtaaataaagaaggagagcccaatgagctggggttcgtgattttggggtcttggatttggctttctgaagcagaaagaagaggggtcgcgagagtggacactgcactgtataagaagctcaaaaaaagcgtgcccgccatcatcgaggactggaaaattaaacggcggtcttataatgttgatcaccagtcatgctttacgaccgatagcatccctcatatcccccaggatacccgaggcaagtggaaagtcatctacaccagccatcagggccgactgagggaaggcgtctataggaagcggctgtcagcccgagtacggaggccatttagatga

SEQ ID NO: 14460 - RNA, 1095 nt, unidentified
  source 1..1095: mol_type = other RNA; note = synthetic construct
atggagttcaaagataccctggcaaaagggatgagctacacaaagcagagtatcgctcgttacaaccccaacgtcaatctgcataaattgggcgcgaaaatcgtggcttggcataacgccaataaaggactgagctactccatgaaaacaatgtatgttgtcaaaaacgacccgttaggacggttcaagaaaggcgcaaaacactttgagaaggtggatggcattacctaccgcaatatcaggttctacaagagggagacgcgggagaagctcgtggaaattctggattgtcttgacctggaacaccccaatcaaatcggcttctctagaggcaaagggataaaggacatgctgaagcttgataacataggggagaggaccaagataaagctcgatctgtctaacgccttcgataatattaccaaggagcagttgaaagccctgctggtgatcgtctttgagatcaggcctaagatcgcagaagaaattgcctcagcctggactgtgaacggtcacatggtccagggtcatccactaacccccgcagttttcaatttactgaccagacaagctgtagacttcgtgataaagtacgtaaagaattgcgggatcatccagtatgccgacgacatcctaatttggcacgacacacacgattacgtttcctggaagactattagaatggtgtgcaaagccttcaaaagagccggatttcctatgaacactgaaaaggagggcttttatcacaagggggcagaaattcagttcgtgggtctgcggtatcgtcgagacactgacggaaagtataaatggtttcccaaggagatgcgcaaaaacaaggcccgcctcagagcgtacaagcatctcaaagctctgggccacctcggtcttgatcataaggagaaaggatatactgaatggctgttgtttcgaaagcgcaataagcagaacaacaaacagattcaaacgcttaagggggagtgggtcgatttcgacaaggctgtggagacaatgctcaaattgtttccaacaaaggaagaacctcagtgggctgaatttaataggctcccaatccgggagtttttactgatttga

SEQ ID NO: 14461 - RNA, 1185 nt, unidentified
  source 1..1185: mol_type = other RNA; note = synthetic construct
atgtattacaaacgagagaatcttgccactttacgccaggagctaattaggcatgtgggaatagaggagttcaataagatttcagcgactgtgcgaacaaagctggaaaatttcgaatactacagaatcggatacagcagtttctggatcaataagcgcaccaaagctaaagtcttcagcaagtccgaaatcctgaagtctaacgatgagcaccggcccattaaaagtcctaagaaagatctgaaggtcctcaccaaggagattaatgagctgttttccagctttacatccaaccgttattatataaagggattcgtcaaggatgaaggcgtacagaccaacgcagagtatttccggaaatacggcggtatcaaattcgggctgaacatggatctcgagaacgcatttaaccagatcgattacggcaacttgaaagatttcgggaaaattgttatggggtggaatgccaaagtgtctgaaaaatttgctaagttgctgactatcaagggtcagatggtgcaggggaatcctctgtctccgaccatgctgaatctttttgcaatacccatggacctgacaatcattgaattttccaagagtcaaacagcccccttactttacacgcggtacgctgacgacatgctgatcggcagcagaacaaaaatcgactttaagaccttcatcaacctcctcaagataattaaacagttcggctttaaagtgaagaaaaagaagaccaagttcatgaagaacaatattgagatcaccggtatcattctctataacggaaagagatggaaaacgaaacggggaaggaagcgtagacttgttaagaaaatccgcctgatgaaacatctccaatctctgggccttaaacacacaaagagattgaacaaagaaggcaagctaattgagatatcctgcgtgatttcagggatcctggcctggttatatccagcctcaagcaagaaaaaaaaaagtaggaagaaccggaagactaagcaaaactccaaattgaacaggaagttttcgaagaccaaacatgacaagtctctcgccaagcagaataagaagttttcaaaggacaaaaggcagaaagttgctaagaatgtagaagaggaatatcgcatcttctgtatgacaaatcaccacattctgcgccgaaatagcccaactactacctga

SEQ ID NO: 14462 - RNA, 1032 nt, unidentified
  source 1..1032: mol_type = other RNA; note = synthetic construct
atgggccataaaccatgccggtcatgtggtgaaggcggctacgctgagaggcagaaccagttcaacttccagttgctgagcttcagtcacgtgaaactgaaccccaatagctgtctgagtgccacacccgtgagggtcctgggaatcttgacaatgttcacgcgaaagactgtctatgatgttaatcggatgtccggccagaagaaggcccgggaagtgtgcaatcctggccgccacctccgaacaatccatggggcattgcgcaggagcttggctcctctcgttagcgccctcgcttattccgccggatgccgcaaaggggattccccacgacgtcggcttctccgccacctaggtgacgttcacttctacctcattgacctgaaatctgcctacagggctgtccaactggctcccatggcgcgcatcctggctaggatttcccctagctgtctgttgccctctgcagaccaaagtggacagtataatctcccttacctgaccgagcaggagtcagagcgctggctgctgcagtacgcatttgatgacaaattcggagggttaatggtaggcgctccggccagcccggacctttttaacctttacgcgggagagatgattgacgcacccctgtcaaagctggccgcaagatatgggcttcgatacagccgttatctggatgatctgctattctcagcccccgccgataacccaataggtcaaaagaaacggagagccatcagaaggatcctcactgaagttgggtttgctgtgtccgaccacaagtctagactctgggacatacggaagggtccaatcgtcgtgaacggagtcggtctggatgtgtcgggccgtttttttgtgccaggcgcctttatgaggcggcttaacggaattgcacatttggtaagaagaaggatgctgcctatctctaatctcggcggcctattaggggcggtgaagaatattctgtctacccagcatcttaatagaagtcaggggaaggtgttagctgccgccgcatccacctga

SEQ ID NO: 14463 - RNA, 987 nt, unidentified
  source 1..987: mol_type = other RNA; note = synthetic construct
atgtacaaaatctccgatttcttggctgagttggaacggagcgcctataccaagcccggcgaactgtcactccgcccgactttttccgagccgcctaaatgggaaaggtgggctatcagagacatcaacccattatctggtcaaaagaaggtgcgcatgctgactgttcccaatgaggccctccgttttctgcacaagggcctgatctacctgctgagggtgagcaagaaggcatctagtgcgcttcattatgcccgaggcgctagacctggatttagccaccagaggttagtgtcagagcaccgaggtaaccgcttcttttatgtggtcgacctgaaagatgcgtactcccaggtcgaccatagcctcatgattaagattgtgatcgagtttctacgagcaattccacacttcgaggccttctctgaggaggatgaagccggtgtgacgatattcctggagcgatacttccttttgccagaaattcctggcttgcccgtaggactcccagcttctcctgatctttttaacgcctacatcgggaccctggtcaattggcgcatctcgaagatgatatcagccggccactacacacattatctggacgacctggttttcagttttcgtagtagaccttccagaaaaaaaaggcgggagattagagaaacactgaagcagtggagactcccaatcaatcatgggaagtgccaattcaaggacttaaaaaaaggccccatcgtgattacagggattggactggagtacggcggaaggatgttcatcccccgcaattatactaggaagatagcaggactagtccaccgggcactggaaaccagggatccccacgagatagctcgcgcacgtgggatggtcgggcttgttttgcataccctcaaagtggcccggcaggtaccaaatcagcacgaagagaagcttctccggagctttcggaaactgcaggatgaccctgaaaacaacagatga

SEQ ID NO: 14464 - RNA, 951 nt, unidentified
  source 1..951: mol_type = other RNA; note = synthetic construct
atgttcatcgacattaaggagtttctggagattcacgatgatcccagatttgacaagtacaccttgagggatgtcaaccccgtgtccaagcacatcaaaactcgcgaaatcagcaatcccaataaaagcatgagagaaatccataggcggataatacaggcagtgaaagacgtctaccttgattcatcgaatcacttcagtagtacacaccaaaatgcggataggcacaacagctcccgatttttctatcagaccgacctcatgcacgcttacgcctcagtgccgttagaggggctcgttactattctgtcttcccttaaaccaacatggggcaccaagaatgttagagagatcttgacaacctactgctttgacgagagcggagcaggtcttatagtgggggcaccggccagccctattctgtttaacatctacgcctggcagacacttgacatccctctgctagaattttggccatatatgaacgacgaaggtcaaattttccggaagttctacacgcggtacctggacgatctcaccttcagctctcctgagccaattacagattctattcggaggtccatcagacgagtggtcgagcaggcgggctttcaaatcaaccatcgtaagtcaacggtcagagatctgaaaaaaggccccgtagtaataactggcgtggggctggaatatcggcccaggcgatctgcccgtctattcctgccacgccactatttgaaacgcatgaacggactgctgcatctcgccctcaagggcgaccctcgggttagtcactctgaaatcgagggcctgatgggtgtgttctacggagtgttgggaagaaagcatcgccagtcccatcagagtaccaagctcaatgctactgaatcaaggttcttagagatgtatggggcttatcgtgctcagtatgagcgcgccactaaccgcaagtga

SEQ ID NO: 14465 - RNA, 927 nt, unidentified
  source 1..927: mol_type = other RNA; note = synthetic construct
atgttcatactgttctcctcttttgtgaagggacttcccgggagggaggcacctggcttcaaattcttttttctacaggatcggaatcccctcgccagacggcgtaaacgcagacacgtcggagcgccgaatgaagcaatgtggcgccttcactggcgcctgatccaatggcttcgaagcccagggctcaatcggggacgcagatacagcacaggttgtggccacctagatagcccaaggcgaaacattctaaggcacagaggaaaccggtttttatacttactggacatcaaggatgcctatccaaatgtcaacctcgataagctcgctaagatactgtatgaactggccatccatctggttccggaggacaaaataaagcttttccttaagctgttctgcttctcacctaacggtggactggtggtagggggccctgcttctcctgagctgtttaacctgtatgccgaatccttgctcgaccatccactcggggttttttgccacaagcatggtattaccttcagtcgttatctcgacgatttgacgttctcctgtagtacccctattggcaaacgcaagaggctcgagattaggaagattatccttaaggcaggctttaacatcaatcactcaaaagccaaagttgtggacctgaggaaaggccccgtggtaatcactggcattgggttgaatttgaacggcaagctgttcgtcccaggacattaccgtagaagaatcgatgccgtgtttcacaaggcggctaaaaaccccaaagacctgaaatacttggcaatcgggatgcatggactgtttagatctgtgatcccccgaggtgagctgaattcccggagtgaactgcgaacaattaaccggttcaggtcgtttctgagcgctaatcggaacaaggaggccttaacccgctga

SEQ ID NO: 14466 - RNA, 999 nt, unidentified
  source 1..999: mol_type = other RNA; note = synthetic construct
atgtcagagaaacaattgagcatcgacttcccgaccgatcatttcttgttgcagaataaatcacctcttcccggatacaaaacggaagaaattgtaacctattcttcttcaggtaaacgcaaggttcgggtcatatgtaaacctaatgagacgctgcggattatgcacgacatcatgaaggaggtcctgtctcccgtgtataataagaagaatctgccttatgcttaccagtggatcaagggaataagtacaccccccatcgcagctctacagcatcacaaggaaaacagaaagttctacccacgacactggtttgtcaccgatctcaagtcagcttaccactccatggatctgatcgaggcctccatctacgtggagatcttttgccagattaacggcatcaaccctgtgattgattggacaatatctatgatactctactgcactgacccaaacatgacccttgcagaaggactgcccgttagtccgtggctcttcaacatctacgcacactacaagctggacatttatctcgccctactggcgcataaatacaatgcccgttacagccgcttaggcgacgatctgattttttccagcccagaaccttttggtaagaggaagagaaaggccattctgggctttgtaaggaaccaagggttcactatttccgaaagaaagaccaaggtgatcgatttgacaaaaaatcatggcgcgtcgattaacggtatcgggatccggaacacagttagcaaaggggagcttttcctgcctcgagattatagggctaaaataaaagggctgctccacgtcgcactttatgggctcgacgagaatggcaggctgaatgacccaagcaattttccagagatcaacggaatgatggccatcttcaagaagttagtgcccaaaaacgtggactcctggactaaggatgacgactggattgtggagaactatgaaattttccgcgagagttttcataataaagccggctga

SEQ ID NO: 14467 - RNA, 966 nt, unidentified
  source 1..966: mol_type = other RNA; note = synthetic construct
atgattccttcactgagaggcctgctgattcttgaccccgagccctcttcccagaaaggaggtggcaggaagcacaacaagaataaattgcattacatccccaacgactctctgcgggtgctgcatgcctatgccttaagaaagattgaggagtacatttttgagatgccaagtgcaaccgggtggataaagggacgcggcagcatcaccaaggaccatattctaagtcacacaaacggacaaggtttttttcacgaatattggtacatcactgacattaaggatgctttcaggagcgtgaatcttcagaagatgtcatgggtactgtgcaacctctttccttactatgacttcaccaactggccagatatgaaggaatacctcaagaaatacttcttcgcaccgggaggctccggattagctgagggctatagcacatctcctaagctgttcaatatatacgccgagaaaatgattgaccagcactttagagaactgtgtactcaatataacatcagctacactagatttggagatgacctcatattcacttctgacaccattatcgggaaaaaaaagaagaaggcattgctttcgatcctgcgagtggctgaattcacaccaaatgataataagacgcactcattcaatctcaataaactcaaggaaggtaaaatcatcaacggggttgggatccgcaatacttcaacccaggcggagatcttcttgcctcgcagcaagcggaagaaactggagatgctactttatttattctggtatgatgaggccaaactcaatcccaggaaaattgagggtctgatgggctggtttaaccaggtcacggatagttccaagaaagggaaaaggaccctgaacacatccgaagaaaaaatcctcaagtactacaaccgggcctcctttggcttgaaagaactgatacgagaaatgcgtgaggagacaacctga

SEQ ID NO: 14468 - RNA, 1191 nt, unidentified
  source 1..1191: mol_type = other RNA; note = synthetic construct
atggcacggcgatgtgtcccggtcgttgcctccacacctatgtgcctggactcttgctccctgctgacaagcggtcgcagcacccaatactcctacagcagcggcagtcctcggctgatcacgggtttttatgatcttggagctaacatgcccctgcacaatactggacaattggaattggagttggaagccctcatggaagagcccttattccacagcttcattcacaaagacgttaatcggcttagtggaaacgtaaagtttcggagggtgagcgcccccaacaaagcaatgaggaagatccacctccagattcgcgcggcactcagtcgtctggatgtggaaatgccttatgtgaccgccggcctgcgaaaatccaaggtggttaatcacgtcaaggctcatagagggaatcaatatctgtgttgctacgacttaaaagcggcttatgaccatgtccggcctgaggccatggctgatatcctgcggcagcatggccttcctgaatccgacattgagttggtggcccgatattgtttcggcaacgagtcaggagggctggtaaccggaggactcgtatcagtgcagctatttaacctgtacgccaacgaagtgattgatcagcccctggctacacttttcgccgagagggggggcattacttacacacgctacattgatgacctgatcatcagttctggtgctcccattggaagacgtttcagacgatcaatactgcagataatccgcgccgccggctttgagataaagcctgctaagactcagcttatcgacctcgcggcggaacactctcagatggccgtgctgaacgggatcgggttggacctgaatggcgagctacacgttcgcccccattacagagagctcctctaccgcctcatcaagcgggctcaggcaggggagatagatccatcagtcgtgcacggatgcatgggcgcattctatgtgatcaagccaagaggccaacagatgacccctggcgagcgcaagctagaccgtgcctacagatggtacgttaatcagcagaggagggcagatccaggtaggccagaaagaaggagacgtaaacaacagcagtatagggcaagacgccgattaaaaccgtcgtacaaaaggcatgggaggcggtctggtcccgtgggtacctatcggccaagaccaacgttttga

SEQ ID NO: 14469 - RNA, 984 nt, unidentified
  source 1..984: mol_type = other RNA; note = synthetic construct
atgaagaccgaaaacaatcctgccttcaccaaacgggtctatcaggacttcaatcccgtgtctagacacagaaagacgaggattatttacgagccaaatcgattaatgaggcaggtccacgccaagtttttgaaggagttcggaggcttcctgccacgcggtctgcctattactgcttgtatcccgggggcgtcaccaaagatgaacctagaaccacataggcgaaacaggtatttctacctgactgatatacatagcgcgtattctggcgtgaatatctatagactggcctcacttttgtgcagcctgaggcctgaccttaaactcttcaggggtgacaagctgccccacgaacccctcgatctcttcagagctgaggacgggatggtgagctttctgaggtcctattttttcgccgaggagggaggattagcaacaggaggccccgcagcaccttttctgtttaacatttactgcgccaattttttggatgtacccctcatggaattgtgccgcaaatgggagcttacctacacgaggtacctggacgatctcacttttagcgccgcagacggcaaccccattggtgacaagaaaagagaagcaatccgtgccgttgtgatctccgctggcttcgaaatatctcatcgcaagagtcaggtgctggaccttaaaaaagggacaatttctatcaccgggatcggcctcgagtatggaggacgcctgtttatgcctcgggcttataccaacacactgagaggggctttataccgtgttgtccggcgccgatcggacgatgatgagcgggtgagagtacggggcatgtactccgctttccttagtctcatagatctgcggagtgccaattgtactgaaaagaagatcatcgagctagcggggcgtgcctttccacctaaaccgaaaaagccaggctacacacccaaaacctcctcacgacgcaagcgccggagacaactggagtga

SEQ ID NO: 14470 - RNA, 990 nt, unidentified
  source 1..990: mol_type = other RNA; note = synthetic construct
atgtccaaggagacacgatctatcaccgcgccaccagctaccgagcggagattcataaacggtcgtaacggcggcaagagacgagaagttttcgtgcccaacgccgctatgcgggaagtccacgcgcaggtgattcgggagactcgtcttcagctgggcatcccctctcacaactttgggggcgttagaggcgggtctgctgttcgctgcgccatgcaacattggggtaatcactacgtctacaagctcgacttgtataacgcctacccttccgtaagacccgagtggctgtaccccgtactggcagaggtgaaatcagaactctgggtcgatcaggttggaatggaagactttgtgagacggtatttggctactccgcggggtcgcgggcttatgaccggaacacctgccgcaactgacctgttcaaccaggtggcggcacgcaaactggacgaggccctgattgagttagctgaaaggtggagccttacatataccaggtatatcgatgacctggtctttagcagttgggagcctattggaaggcggaaacgggaagctatcagagccgtcataaagaggagcggcttcaggttgaattacaagaagacaggctactacgacgtggcccgacgccctgtgatgatcactggactaagactgggcgcaggtccatcagccggggaagctagtgatgatatcaatcgagccttcgccatttatttaccacgcaagtggcttcagggactagagggatcgatgtattgtctggtcaatgggaaaagcaatagagtgggtaaggcaatcgagcctggggtggtagaagggaggatgggggctctgagggaacatctcgcactcggcggatttccctttgatcgccaggcagccttggtttggcgtaaatacacctatgtgaagccaattacgaggcccaaagtgccgctgtcccctatggaggagtggctccaacggctcttccgcggctga

SEQ ID NO: 14471 - RNA, 972 nt, unidentified
  source 1..972: mol_type = other RNA; note = synthetic construct
atgtcaaacaagccgatcttggcggcccctgttgaaggggccgcctttagacacttctttttaaaagacgtcaaccccctcgggggtcgtacaaaaagacgccatatcagcgcgccaaacgctcagatgcgtgaagtgcactcggcactcatttcatacctgaggagcctgccagcagaccttagcgctgccactggcgcacgaaaggggcatagcagtattaccaacattttcccccatcggaataatagatacttcttgctcctggacattaaggatgcctatggcaccgtagacgaggagaagctggtgcaagtgctcctggagttggatccaacactccctagggacctctttggttctgaagtggttacccagtttctgcagcgttactgtcttaacaataagggcggcctattaacaggcgcacccgcttctccggacttatataatctttacgtcgccgtccttctggattctaaactgatcgaactgtgcaagcaatacggactgacatataccaggtacctcgatgatataactctgtcctccatgacacgcatagggaaaaagaagcggcaggccatctacggactgatgcgcgaagctggtctggtgatccacgagtcaaaaacccagatccttgatctgaatcggggccccgtgaaaatcgctggtttcactttgaatcaaaacaggtccataattcttcctcggtcctatctaggaaagattcgaggggccatccacaacgccatagagaaagggctgtgcgataaggctacgcaagtgcagatcagtggcatgatgagccagctcttggctagtctacaggacccctccgtacggagaaagggaggacgccgatatcgcagaaggcctaatagcactgagaaaagggttatggaccggtattgtgcgtacagacagctgtgcgcacagacgatttctccaaaactggccacctcatga

SEQ ID NO: 14472 - RNA, 951 nt, unidentified
  source 1..951: mol_type = other RNA; note = synthetic construct
atgagtttcgagaacctggtgctgggatttgagctaaatccagctctattgggggggacccctgcattccggatcttcgccattagggataagaatccgttaagcaaaagggagaagggtcggcgtcctctggaggcacctaataatgccatgcggataatccacggcagactcatcaaatatctgagatccttgaaggtagagatgccttatgcgacagcatgtcgcccaggagactcaccgctgaaaaacgtggaacgtcacagacagagccggttcttttgtctgcttgacctgcgacgtgcttatcagtctgtgcaggttggcaagctggcaagtgtcctccaccaagccgacccccggttaaagggccagttctgggaggtgcgggccttcctccagaggtactgcatgtcccagacaggcggtgtacccgctggagctccagctagccccgatctgttcaacctttactgcgccgtccttttggacgaaaagatcgggaacctgtgtaggcaacatggcctgatctatacaaggtacgtcgacgatcttactatttcgggcaacattacggtgtcaagacgagtccgcgcccaagtgagagccatcattgcgtctgccgggtttaaagtgaatcatctgaagtctcagacccacgatctccagaaaagcaccctggtgattaatggcatcggtttagaactcggcggaagagtatttgtgcccccattttaccttaggcatgtgcgaggtttgctacacgaaggactgaagggggatctctccttggccccaaagattcagggcgcaatgtcagtggttctcgggatagtcaaccagcgaaaacccactgcctccgaacaacgcgttctcaggcagtgcaaacgctttagacgcctgataggacagaccaaacgggagcaacgcaaggcgcctgctcccgtttga

SEQ ID NO: 14473 - RNA, 1023 nt, unidentified
  source 1..1023: mol_type = other RNA; note = synthetic construct
atgcaactttccctgcacgataagatttttggagtcggttttgacgaaacactgcgaacctttcccgagcctccagccatgcgcctgtatgtccggttctgtgggcacaccatgtcaggccacggcaagatgaggaagctggaggtaccaaacaaagcgatgagggaagtgcacatccgtctgctccggttcctgcggacattgcccagcgagtcctcttacgcaaccggttgtaaacctggcgacagtcccgccaagaatgtgaagagacacgcagggcagtgcttcttttacttagtggacctccggggtgccttccatagtgtggacatacccgtcctggccggcatcctacgaaaggcagctaagttgccgtctcgacaggagtcccaaatcctggccctgctcgagcggtactgtgcctcacattttggcgttgggggtttggctgaaggagtgccagcttccagcgacctcttcgatctgtattgcgccgtgaggatagataaacagctcggcccttattgcaagtggtggggaattcggtatacgcgctacgctgacgatctggttttctcgagcgagcgaccattaagtagaaagatcagacagtacattcgcagaattctggaagaggccggattcgctatctctcaccataaatgtgagctccgcgatctgaagaaaggacccattaagatcaacgggataggccttcagcctgatgggcggatgtttgtccccaggcctttcactagacggacccagcaccttctgcacctggtactcgagaaaggcaggtgggaactattgcttcaggttcaagggcgaatggcgctgtttcgccaacttacagacgtcagaaatccaaacaggactgaaaaacatctcttggagcagtatgcagcattacagcgcattctaagaaaagaaaagatgcgcgctcgtgagcagaaaaagagggtgaggcagtctggaagaccggaatacctgcatgtgtcacgtagccctatcgcctgctga

SEQ ID NO: 14474 - RNA, 939 nt, unidentified
  source 1..939: mol_type = other RNA; note = synthetic construct
atgtttgacaatctgagcgatcttctcggggatgaaccgagtttcagggttcacagactgcgtgacgaaaataaggtgagtggcgtcacaaaatggcggaccatccatgcccctaacgatccaatgcgcaaactgcattctcgaatgattgtcgacctgcggctcttgcaaacaaaggtacacggccgctctccctacgctaccgctgtccttcctggtagctcacctcgacgcaatgtggagagacaccgcggcaagaggtatctatacttgctggatttgcactccgcttatctgtacgtgaagggaggagagctcgccttcatcctatgcactctcgcggcccaaagggacggatatttggttgcagacccctcggagctctcaagcacccacgattttctgaagcgatactgtctcggcaccactgggggcttactgacaggggcacctgcaagtccagatctattcaacatttacgccggggagcttatcgaccagagactggcacccagactgaaacggtggggattaacctattccagatacattgatgatctcactttttctagcaacgagccgatcggggaacgtaagaggcgcgccattcgcgacgtgatagctgccgcgggcttcgacatatcctaccggaaggcgaaagtgtacgatctggctaaaggtccagtgcagatcaatggcatcggtctggaccttacgggtaggacatatgtgccccgtaagtatcttgggaaagtaaacggaatattgcacctggccaggtacggcatgattaaacccgcaaaggttgctggctacatgggagtctattggaccgccactccaagatcacaccaggggagaaatagggccgaatgccatacgctcgagttatttcatgactatcagctgcatcggaacgactggctgatccggtcctga

SEQ ID NO: 14475 - RNA, 990 nt, unidentified
  source 1..990: mol_type = other RNA; note = synthetic construct
atgattttcgacggcattgatttaccaaggtctggcaccaaagccgaatttaaggcctggcagaagagggacgtgaaccctctggggagaaccagccgcatgcggacactccacactccaaatgaagccatgaagtatctccacgaccgcctggtgatcaacttaagaagaattaaggcagtggatctgacttcagcagctagcaagccgggcggttctgcattgcggaatgtgctcaggcacaggcataacaggtacttctatcttacagacatctcaagcgccttcgacagtgtagattctcaccggctggctgccgttctagctggcctcgatactcaggtgcgcgaaagtgaggtctacgcctttttgcggcagttttgcatgacggagcagggagggcttatcactggcagccccagttcacctgacttgtttaatatttattgcgccgtcctgatggacggccagatgcgagagtactgtctgagacatgaggtgacctactcccggtatttggatgacctgaccttcagctccaaacaggttatcggtgcgcggaagagagagaagatccgtgagttaatctctctgtccggtctgcgcatagggcatcataaatccagggtgttggacctcaaaaagcaccggatcgagatcaacggaatcggacttgaatacggagggcgcgtatatctgccaaggtggtatctctacaagattcgaggtctgatgcacgtggctgaaagatcagaagatccaaaactgctccagagagtccacggaatgataggactacttcaggcatcgacggatgcgagtcgaccccgcaataggctggagacaaaggttttcagcgagtacgcccaactgcgtcatcagacacgaaaaaaacccttcattcctccccctcaagggcgtgctccgattggcatacaaaccggggacccttggggctcccttgacgatgatgacgatgtccccttttga

SEQ ID NO: 14476 - RNA, 1035 nt, unidentified
  source 1..1035: mol_type = other RNA; note = synthetic construct
atgattttagaaagcttcactacaggactcccagggaaacccgcgtggcaaccgtttaggtatcgcgatgtgaaccctttgggcgggactacgaaggttaggctactgggagcccccaaccccgctatgcgccttctccaccataggctcgtcagatttctgcgcggcctgaatgtgccgatgccacacgcagtaggtgcaagacctgctggctccccagtagtcaatgttagacgacacctctacatagataatagggggcggccagctagatacaggccgaatcggtatttcctgctgtacgaccttcgccatgcctactgtaacgtcgatcctggtctgttggcgggcattatatgtcaacattgtcctgaactgaccgttcaggacggcgccgtactggacttcctcctcggatactgcttcggaccaaatcctaacaagccttaccagcttgagcttcccattggccagcggcgtcgaggagggcttgttcaaggcggccctgccagtcccgatctgtttaacctgtacgtggccatcactctcgatcagcccctaggtgagctgtgccagcgctatgggctcacatattcccgctatcttgacgacctgaccttttcttctcgcgaaagatcaatcggaacaaaaaaaagacaggtgattcggcggaagatccgtgatgcaggttttaccgtcagcgaccggaaggctaagaatttggacatccggaaggggcccctgactatcaatggggtctgcttgaacaggcagggcacgatcttctgccctcgttggtatctcagacgcatcaggaccctggtgcacgccgctagaaaaggcgctgccgtggacctggccgcattacacggaatgatgggggtgttcaccgccaccttgccaaggcgatgggagttagtggacataaacggaaggcgttcggaacggagagtgccagtgggtagactgcggattgagcagaaaacactggatgagtaccgacagctacaggcacgacagcgcaggcaaccctga

SEQ ID NO: 14477 - RNA, 1038 nt, unidentified
  source 1..1038: mol_type = other RNA; note = synthetic construct
atgatcgataagctgacctttggaattgatatcgaaaatgccacgttcaaaatcgtcgtcattaatgataagaacaacctgtctggaactaaaaaacgccgtgtcatccacatgccttctcctgaaatgcggatcattcacaaacgcttaatacggtggatccggggacagaagcgacttgtgcccatctccgcttctgggtctagaccaggtgattccgtattcaaatcggttttcattcacaagaagacaaggaaacattcatatgtgagtaacggatacactcacattgacactatcggctggttcccccggcactttttctgcttggatattaaagacgcctttccatccgtgtcagttagcaaaatgacagaggccctgctgtttgctggcttggaccccaatgactattcatacaacaaggtaattagcatcctggagaggtactgttttactaaagaggacgggctgatagtgggggcaaatgctagtccggacctctttaatatatacgcagagtattttctcgaccgcaatctcagaaggtactgccatgagcatagcctagtctatacaagatacctggacgacctaattttcagttccaataagacgattggcaaacgcaaaaggaagagcatctataagttcattgatgaaagcggccttaaggtgaatgagaagaagacaaagatctatgatcttagaaaggggtgcgccgttataaacggcatcggcgtcaacgaaaagggacgaatgttcatccctcgtcaatacctcgacaccctgagaggttacatgaacttataccttaaggggaagatcgagttgaaatttaattggctcaggggtaaaatgaatcctctcttccagtgtcaggaacagtccgatctgctgccaaaccggaccgagggcaaggtgtttgacctcttcgaagaagtgaaggtgcgattaaaattccccataaacacctcactggatcatgacgatctggatgacctggcgtatgagaacaccgacgatttgaacttttga

SEQ ID NO: 14478 - RNA, 984 nt, unidentified
  source 1..984: mol_type = other RNA; note = synthetic construct
atggatcgcatcctgtttaccgagagaatgctctgtaatataggcttgcagatcttgcctcatataaaggacgaagacttttacagttttcgggagaagttccaggagaagcacctccatcacttcgtggtgaatgatatcaacagcctttctggccaagaaaagcagcgtgaggtcgtgaaattatctacagaattggatctgtttcagaaagctttactctcaaggctgaaaatgcactatggtgaggttctgagaagtgagatatcgaattcccacagatccgcacttaacactattctgtgtcacaaaaaggtggatctatatcgcggagaaaagaggatttacttttccaggttctactactctatggatattcaaaacgcgttcggctgtatgacaaccgaaaaggtactggaggttctcaagggagactttcaagacgagtctctggagaagatcttaaagctcacttgctttgacctgcatcgtggcatcattacaggtgctagtgcatcatcatacctgtatttcctatactggcagaagaaaattgactccaagatttatgagttgtgccgcgaggaaggtattatctgcacaagatatgtcgacgatttcctgttctccagtgagcacaaaatcaccaaaagcttcagcaagaaagtacttaaggtgatccgcaatgccaactttgaaatcaacttccagaagacgcagttttatgacctcgggcgggaaacctttaatgtcaatggcatagttttccgaaagaaggataaccggggggctattggaatacccaaaactaggagcaggaagctgttgggaatgcttaaccaatacgaaaaagggaacatcaaaatcgcccagctggcaggcgccatgtcactcctggagaaaattagccaggtgcataatggggccttcctttctcgaacccatcagaaaatcctgagccggtacagaaagctgaaacggtga

SEQ ID NO: 14479 - RNA, 945 nt, unidentified
  source 1..945: mol_type = other RNA; note = synthetic construct
atgatttttgacagactctgtattacagagaagcccaatgctgccttcaaaccgttcataaacaaaaaggggcggaaattgaatcggcaaaactctgacatgcgtgaagtacatagagccttcctcgccttcctgaaaatccaggacatccacatgccttccgcatacgggactggtggaaaagcaaggaacctgtggcacaggtttctgcagcacagagataaggacacaggtaaatttcagaaggaatggtacatactggacttagctgatgcctatggccatgttaatatggaaaagctggtcggcgtgatcctactcacctgcgacaatgagcttcggaggcgatcagatgatttgctagcgtttctcatgcggcattgttccagcaccagagagaaggggctcattcaaggagctacgagcagctcctttctgttcaacctgtaccttgacgaactggtggacattcctctcgagagattctgcaaagctcatggagtgacctacactaggtattacgatgacttcgcctttagtggccagaaagggacactgttaagccatcgccgtggcaagcttattaggaaaggcatacgcaaaatactgatcaaggcaggattcgagattaatcacctaaagtcgaaatgctttgatctcactaagaagccaaccaaggtgaacggcgttcttctggattattacggacggatctcactgcctaggccagtcatcaagaagatgtctgggttgctccaccgtttcgtgcacggcaagcacctgagttcttttgttgtggacgggaacttaggtagagtacaggatatccatgatatcttggagcccacctgttgcatcgaacagcgactgcttattctgtatttggagtactatcaccaccgctttcgcggtcgcgtccgaacacggcaggacgatcccttctga

SEQ ID NO: 14480 - RNA, 1098 nt, unidentified
  source 1..1098: mol_type = other RNA; note = synthetic construct
atgcggcggatagtgatgatccagcagaaccacgctgtgctgcgaggaagccgcactgacgccgaggatgatccactacgttttgtgactatggtcggtgggtgtccccgcattgactttcattggaagcaggataccaacggaaaaaggcgccttattgggaatcctaacaaacccctccgtcggctgcaccgactctttggccaatatctagaggaagccattagcaagatgggcaaggagaattacgagctcattaaatttccctctagtaccgctttcgtcaggggtaccaatccattgaaaaatgcccagaaacaccaaaagggcaggttcttctatataacggattttgcaaatgcataccccagtgttgatttggtaagattagcggttttaatcgtgtatatcaagcgccataacgtgtacggactggagatgagcctgcggatgcttgggcagaatagagtcctcgtcagagaactgcaagaggatccgctcttcctgagtattttggcgttcctggaaagctactgctcaggccagtatggtcgaggccttgcagttgggggaccaaggtccccctacctgtttaacctgtattgtgaagtgtacgccgacgccggcttaaggaaggtgtgcgagcgctacggaattacattcacacgatacgccgacgataacgttttttctcgcgacaagcctatcacttccgacatccggcgggaactgaggaggaggatcgagtcggctgggtttcaggttaatcatcgaaaatccaaagtgctttgccgggacatgggcaccgtattcgtgacaaaggtcggtctgagagatcagaacctcgtggcaccaagatcagagtcagctaaggcggctatagtattccctaagaaaaagcgccggagactgcatgggattatcggctcttacttgcacatgcagatggactggcctgagaaagtgtccggacggatcgccgaatttctccactactatagacacgtcgagcgcaggacagcagccgaccataaaaccttcgccctgtgtaaggaattcgaacgtgagtgggctaagtatcgtaagagaagaaaatga

SEQ ID NO: 14481 - RNA, 1059 nt, unidentified
  source 1..1059: mol_type = other RNA; note = synthetic construct
atgcgtcacgttcgcagtgccgccccacaagaacctcccgttgagaactgggatcctttgcattttgcgaccatggtgggcggacaccctcaaatccatttccactggaaggaagagggcggtaagcgcaggttgatcggcaaccctaataaacctatgcgcaagctacacgaagtctttggacagtatctccgtaaaggtatttacgcgatggggaacgataattatactctccgcagactcccgagcagcgctgccttcgttaagggctccaatcccctcaagaatgcccagaaacatattgaaggcaggtttttctacatcaccgacgtttccaatgcttatccatctattgatctggaacggttggcaatccttattgtctacatcaagaagtactacgagtacggcccgaacttttcattaagtgcattcggacaaaatgccagcttccgggaccaggtacggagagattggctgttcccacccgtgcacgctttcctggaatctttctgtagtggcatgcatgggcagggtttagcagtaggcggcccactctctccctttctgttcaacctttactgcgaagtctttatggatgcccaggtgcgcaaactgtgcgagcggtatgacatcacttacacccgatatgcggacgattgcgtcttctcacgccacaagccaataatcggggacattagacggaacgtgagggagtgtatcgccagggctgggtttgaggtgaatcaccgtaaatcaaaggtgctatccagagagatgggggcagtgttcgtcaccaaaattggtcttcgaaacagaacaggaaaagaagacgggtccgagacagccaaaattgtgttcagccagaagaagcggagaaggctgcatggaataataggaagctatctgacaatgcagatggactggcccgagaaggtgtctgggctgatcgctgagtttatccactattacaagaacgtggatgagtcgacagcaacggacaggaaaacttttgctctgtgtaagctgtttgaagccgagtgggccaaacatcgatga

SEQ ID NO: 14482 - RNA, 1041 nt, unidentified
  source 1..1041: mol_type = other RNA; note = synthetic construct
atgagggatatgatcatgaggcctgaactagtcggacaggcctgtggagggtaccctctcataaacttcgaagtgagagacgtgaggggaaagtcccgcctgatcgggattccaaatcgtcccatgcggtcattgcatcggcaactgggcaaatttctgcgaggaatcattatgcacaccgacggcagcggctacggcttacggaagctgccgtccgcttacggttgtgtcgaagggtctaatcccctgcggaacgcatctcaacacaaggaaaatcagtatttctacatcaccgacatatctaacgcatatgggacagtgagtctcgagaggcttgccctcctgctaacatacctgattcagtacgaggcctacgaggagtctggtttttccttggcttggtttgggcaagatgaacgagtatgggtactgcgccaggacgaagcctatcagccggtcttgggtctgctggttgcgcactttggcgggcttcatggccagggcttggcaataggcggtcccctgtcgccatatctcatgaacctttattgcgaggtttacatcgatgcccccctcaggaagttctgcgaacctagagagatcacttataccaggtatgtggatgacctgaccttcagcgcaaaacatttcatcggcgaggaaaccagacgaagaatccgagccgttattagtcgggggggtttcacgctcaacaggcagaagagccgtgcccaaatgttgagtatgggccaggtgagcatcacacagattggattagctcgcgatactccagacggctcaacacgccttgtctttagccagaaaaagcggagaaaacttcacggtattattcactcctatctgactcgcggaatggattggcctgagaaggtgagaggatacgcggccgagttcctgtattactacaaaaatgtggctgtgcgcacagctaccgacgaaaagacgttcgagctctgcaaacggtttgagagagagtggaagttatacggagggccaaaacatcgtactaggtcaaagtga

SEQ ID NO: 14483 - RNA, 939 nt, unidentified
  source 1..939: mol_type = other RNA; note = synthetic construct
atgattttcctaaaaaaggcccacgagaaaacatgtgatgaacttccactgtttttccccagactcattcgccgccagaaccagaaaacgggcgcatggaaaattcggagggtgtacgagcctaacgacgccatgcgtgcaatccacgaggaactagacgagtacctgagatcacagccacggttccctaagcatgctccaccgcgacccgcggaaaatgttgcacctcatagaggtaatcggtttttttacctgacggacattgagaacgctttcggcagtgtcaaggtggatggtctggtgaaggccttctgccttatgaattctttttggatacctaggaagcgaggcctcaaaaacttcctcgagaactactgtatcgctcctgaaggaggtctgtatcaaggagcccccagcagcccggccctttttgagctgtacgcctgggctttcctggagaggcccatacatacctggtataatctcaaaaagtggtgcgggtggaacgatgtcacatatactaggtatgttgatgacttgactttttcctccaaaaagcggatcggccgcgggactcgacgccaaatcagacgcttgttgcacaacgctgaattcaccatcaacaatggaaagaatttcgtgatcgatcttgccaatcccaagactccaagaatcaccattaccggtatagggttagagtacggagggcggatgttcgtctcacgagaaaggctgagggagctggagaaaatgttgattgcggggatcgaaggagaagacgtgaaccctcacaagattgagggctttatgtccgtattttggtcgccctatggcggcaaaagaaggagtgccgtgctcacacgcacccagagacgtatcctgtctttaagccgggcatggcgtaagctgcagaagaagaatcacacaatgaccccatga

SEQ ID NO: 14484 - RNA, 1221 nt, unidentified
  source 1..1221: mol_type = other RNA; note = synthetic construct
atgcaccttcagttgctggtggaacaggcaagcgcaaccgagacaccgcctgcgttttctgtcgtgaggaagagggtgggtaaaaaagtacgcgccatagcagttcccaacgctagtatgagagtgttgcataggctcctgatcaatgaactggaggcaccggggtacctgttagaatctgcaacagccaaaaagggttccagcatcattcaaaatgttcggcctcacctgcatgcccggtcagtctacctcctcgatttcgctcacgcctatcgttctgtcccagtgcaaaagctggcagcctccctgcactttcggttcccaaccttcggaacggagagggaaattgctcacttcctcaaacaatattgcttcgtcccccgacacgggttagcacagggagctcccgcttcgcctctgctgtttgagttgtatgccgagtgggaggtcgatacaagtatccgccaatttctggaaagagtagaggacagcataggcggcagaatcaactacacccgctatgtggatgatctcaccttctcagccctggagccaattccagcgtgggttcgacgcggcattaggagcatctgtatgtccgctggcttctctattcagcatagaaaaagtgtggtgggcagcctgggaactaaagtcgttgaagtgactggagtgcacctacttgcccccggccgtgctatgttgtcacgggacttttgcaacactctagagcgcaccttagatacttacctgtctcagctgttctccgagcccgacctgcgcctcgaaggaatgattgtctactacgttgggatgatgcgagctctcggtgacgtgcgggcgagcaatagaagaaccgtgagaatcgataagaaaatcaaggcctacaggcttcggacaggcttcgctccatcacataagaggaagacattttctaatagaacccttgacgctatccgggcccagctacccgtgtcacagattgtctcccgcagcgttgcccttaagcgtgcagggaaggagtataaaggcctgagtcctttcaaagtagaacgaactcctagcttttttgtaaacgatcagaagggattttaccattgcttcgccagtggctcccacggggacatattcacgttcgtgatgtttagggagcagtgtggttttgtggaggccgtcgaaatgttggccaaggaagcgggggtgtccctcgactatgactga

SEQ ID NO: 14485 - RNA, 990 nt, unidentified
  source 1..990: mol_type = other RNA; note = synthetic construct
atgcagccagctctctcttttgatattatgcccaagaggttccatcacaacccaaaccagcctgaactgttcacactgactcgagatggttccacaaaagtacgggacatctacgtgcctaccgacgaagtgcgtatgaaacacgaagccatgctccgcagattgcacgccttggagatcccgtttccccatgcccacggcggattgcctggctttggcgtgatcgataacgtccgcccgcaccaacaatcaaattatttctacaagctggacatcaagaatgccttcccaagcgtagaccacgagtggctccagcggaccgtccatgacatgctcgtcgagaggagggttcgaaaaagcgatatccgcgacatcgatcacttcgtggaagccgacgcactggttgacggttgcccaggcctaccactggggtatccagcttccccctttttgttcaacatatattgtagacccacagacttagcaattggcgcaggcctcgcgcttaggaaggactttggttaccaagtggtccgctattcccgctggttagatgatctcacattttcaagtctgcagccgattgatgcagggcatagacggattctacgtgagtgggttcatatgacccctgggtttgagattaaccacagaaagtcgcaaagacactctctcggacaggggcccgtgaccattaccggcatatcactgtaccctgatagaaggatggccccctctcccgaacttctggaaaaggtgcgagtgcagttcggccagatggccgagctgatcgctgcaggaattgagctgacgccccaggagatcggggagttcaatggataccatagtgtcctgcatatggccggggatcctcttaaaagccggagcgctactgtgaggctgttagctaaatggtacaatcggctggctcttcagctgccagacatggagagtgcggcccctggagaagatggaggttccactgactga

SEQ ID NO: 14486 - RNA, 927 nt, unidentified
  source 1..927: mol_type = other RNA; note = synthetic construct
atgaagaggcgcacagtgttcaagcctgccactccagaagaccttcgaatacattggcggatgttggccaatctccagtcgattcagtgggaattcccccacagcgttggcagcttgcctggctcccatctgatcgataatgtgactcctcacatctccgccgagtccgagcaattctacctcttagacctgaaatcagcattcccaagcgtagacaccgatttcgccctgagagctgtgtacgatggaattcgcaccaggcgcggaagagatgaagcagccgaggcagctaggtttatggtggagacaagctatatggggcgcacacaggacgaaaaacccgacaagatgatgtatgggctcctgcagggcctaccctgttcaccactcttttttgacattatcagtcaagccctagacatgaggctgagacggcacctgcagcgcgtgtttggggatgatgtcgtgtacacccgatacatcgacgatcttacattcagtagtaggcgggcggctttcacccggagaaggaggaaagacatcgttgctcagatcgagacgttacctggctatattgtgaaccatgataagactagatgccaatccctcggaaggggcaccctgactgtcactggtctggacatgagacggaacagaaaatggcccaccgatcgacgtgtactggtggccccgtctggctcacagttagcgtccgtcgaacaggagatcaacgagatgacgagaaagttgcgcgaagacttgccaataacactttctgagaaggcacacttttatgggatgggaagcattctgcacatggctggtgacccctctaaatcaccgatgagcagtgttcgaaccctgaagcgtcggttccgggaggtcgataaagaactcaagaagcttccttctggacgtctgttttga

SEQ ID NO: 14487 - RNA, 1284 nt, unidentified
  source 1..1284: mol_type = other RNA; note = synthetic construct
atgatcgcgctgaagagtctggttcccctacctctattcggcggggctcccacttttaacccccagaatatcttcgacggaaagaagtggcggacggtgcaagccccaaataacgtgatgcgaaaactccataaggaactcattgaagtgctcctcgaactccctatcgatttcacttctgccactgggagtctgcctggtaagagcaatatcttgaacgctaatgtgcacgccggtaaccagttcttctacattttcgatatgaaggatgcttttcctagcgtcccaattgatcgccttgcagacaccctgcatgtctgctcccacggccacttaggaaccagagctagaatccggtcttttctcgaggactactgtgctggaccccgaggattggccgttggcgcacctgcttctccccttctgttcaacatctattgcgccgtcggggtggatccggggattaggaagctgctgagatcagataccatctatacccgatacgtggatgacctggtaatcagcagtagccgcccgatacccaggattctgcgcaagagaattaggaaagtcgttaccgacgctggctttgctatcaaagaccccaagtccaaagtgctcgacaaagaaaagggccccgtgactatcacaggggtggttatcgataaaaaaggacgaattgcacccacaaaagaatgtctggcagaggtcgaggaccttctgtggataccaccacaggaactgaccccagaacagcagaaacgcatagcggggttcgccagctacttgcaatcctttcgggagtttgggcggcaaaaattggccgagggcaatggcacagtatcaacagccccattgtccccagtgctggataccttagccaaaaggtgcagaattcgcctgcgtgagaacaagaagcctagaactcagaagcagcagatgcacctggtgtttcctgaagtgtttattgacgaaatacgggcaaccgcctcgcttagagacgtgatcgagccgtatctaaggccaggtaagaggggactccgcttgaaaaaggtcggcggtgagtgggcaggcttatgccctttccataacgagaaaacaccttctttcacaatcgccgaggagaagggcttctttcattgttttgggtgtggaaatcacggttcagttatagacttcattatgcgtgtagagaggctcgagtttccagacgcagtccggttcctggcgaagaaatatgatcttcccctgccggaacgtaagcttgagcggacgaagaattga

SEQ ID NO: 14488 - RNA, 1260 nt, unidentified
  source 1..1260: mol_type = other RNA; note = synthetic construct
atggccgcaccccggctgtcatgttctctgaaaaagtacggatttaattccaaggaagtggttgttaaggtcaacgggaaaaaattgttggcggacctcatgaactggccagagaagaaaattgaacaggctattacaagacgtagtcggtattacctcgttaaaaaaatcgacaaagacgggtccatacgaaagacgtacgctcccgatcgtgagctgaagaagctgcagaagaggttcctaaaatactttctgtatcggatccctgtgggctggaagaacttgataaccgggttcaggcctggttgctcgtacgtgtataacgcaaagtgtcacgctttagccgatgccaagatcgtgctgcgcctggactttgccaatgcgtttcccactgtcgagacaagctacttgaaaacgattctggccaagattctgagccaggaagtggagtatcatcgaaagggagactatcctttccatcctctattccctgtgaaaagagtgaaatggttcaggagagcgattaaaaattactaccagcttgacctcttctgtgatccagacaagatcatatgcgagtttctcgatcttgtgttatccttcgtcacctatcagggaagacttccacagggggctccaaccagcccgtacctttttaatatcgtactttggtacagtggcctcatccaaaagatcactgcatttttaggcgagaaacgcatatctgtcagtgttggcaacgttttttctggagaggtgatcttcacagcatatgctgacgacttgaccatatcttcctcccgtagcatcaccaaacatgaggtgaacaatctgattgatctgatcgaacaagaatcaccattcaggatcaatcgcgagaaaatttgctactttcaagccgatagaatcgcccctctggtgacaggactccgcctcgtgaagttagtcaaggaagggcgggagctcgatgtcctgatgagcaaagcaaacctcaacagcagggagaagaagaatctgaagcgcaagattctgaatcgcgaaggccggtggattgtaaactctgtatccctaccgaaaaaaggtatccgaaaaattagaggtctgattcacaaggctacttacgcccccccactcattcagcggatgctggaacagaagatcaagggtcacctgagttgccttaaggccatctatggcgataagttgcccaaccaaatatcaaagccctatcagaaattccagcagtcactgaggggctga

SEQ ID NO: 14489 - RNA, 1170 nt, unidentified
  source 1..1170: mol_type = other RNA; note = synthetic construct
atgatctcaaaagaccttctgactagcgtgcttgactggcccgaggaaaagattaacaaagcggtgctatttaaggacagctatcgattgatcaaccggaagaagaaggatggcagtctgcgaaaaatttatgcacctcatccagatttgaaaaggtttcaacgccgtttcctgaagtattttctgtatcggattcctctcatttcttcccttcctatcaatgggttccgtcccaaattctcctatatcgataacaccaaagagcacgcccagaaaaacgtgcggtttgtgttacgactcgatttccgggatgcctttccatcagtgaagatcgagtacttaagaatcatccttaagaaggtcttattcctggaagtaaaggggtacatggagaaaaactataggcaaagacctctgttccccaataaaagagtccagtggttcagaaaactgctgcgggacttaccacagctcaacctgttctctgtcgaccctttgaaaatccttgacgaatttgtggagttgattctaccccttattacataccaaggcaaattgccacagggcgcctctactagcccctgtctcctcaacattgttctgtgctactctggactcctggaaaagatttatcaatttctctgggacaacaggattcttttctccgagaatgacgtttcaatggtgaatagtacaatctacgctgatgacctcacgatctcctctagcgagcccatttcaaggagcagcataaatcagctgatcgatttgatcgagcaggagagtccatttaagattaataggcagaagatctcgtactttaacagagctcgcattgcaccgctcgtaactggactgaggatagtcagattggtgaaggaagagatagaactggaaaacttcctgtccaataaggacctgacctataagcagaagaagaatattctgcgtcgcaccctcaacaagaaaggcaaatggatcatcacctccgtcagcctgcctaagaaacagatccgccggatacgcggactgatataccgcgccatcagtgaaaaagctctggccccaatcatagatggtcacatggctaatctaaaagcaatatacgggcagaacctacccaatcagatcatggttccgtacaagaagtacctgattacagagggttga

SEQ ID NO: 14490 - RNA, 1212 nt, unidentified
  source 1..1212: mol_type = other RNA; note = synthetic construct
atgagtcggatcaaaattgagggaggtgatacgctacttgccggggttttgggcatgccatcggccgacattagaaatgccatagtatgccgcgacaactataagattaagcacattgtgaagaagagcggcgggaggagaaggctgagcataccgtgcaaatccgttaagaagtttcagaagctattcctcaaaaagttcctgtattgtctgatcgaacggggcgtactggacaagaatatgaccggctttcttcccggggtaagtgtcaaggacaatgcgttagttcatctgaacgaaaacctccagtatgtggtgcgcctggactttaaaaatgctttcccctcagtgtcattccgggtggtcaaagaggtgctcctgcaccatgtgaagaacgaaatcggcacatacagggccgtggagattcaacgtctgttaggtaaaaagattaactaccccgagcctgtcctttttagcatgcgcaaagttaaatggttcagagagctggtcagttcactgtcagtcgataactctgcatcttactacctcgactacatcgtggatggattcatagagatggccgcatacctattgacttataaaggcaagctccctcaaggggccccaacctctccatttatgttgaatttgaccgtctcctatctcaaaatccttgataggattcgggagttcctcaaacagaacaacatcgactcccaagtgagcatctacgctgatgacatcgtgattagcgcaaaggaaagaataaacttcggtctgatcaggggactcattggggttgtcgaagcttccagggtgttcagaatcaatcgagcaaagattctccgctttgatattaatcagacagctcccctgataaccggcttccggcttatccgaatcagatctgttaacagaaaactgactgaaagctggcttgctcgcttgcctcggaaaatcaaggccacagtggaggaacgtttattttacaatccccagagtccttttataaatatcactttgccccagaagcagatcaaaaaaattaggggaatcatccatcgagccatctatcaaccaggactggcatccaaggtaaatggttacgtcgcgtacctgaaagacatttatggggagcacctgcctcgccagattgtggaaccgtataagaagtacctgctggtgaaccagaaggatccagaggtggtctga

SEQ ID NO: 14491 - RNA, 1044 nt, unidentified
  source 1..1044: mol_type = other RNA; note = synthetic construct
atgaatacaattcaggagaaggccattatcgtcctctcatcactgctgtctaacaaattctctccagagaagatcaaagagatcctaacaagtggcattagctatagatacaaacctcgcaagaaaaaggacgggtccatacgcgattgctacgctccagccgaggatctgaaagccctgcagcagagcatcctctccgaaatcctgcacaatatacccgtgcacaagaacttatgtgggttcgtacccggggtcgcaatgaagaacggcgtggaagctcatctccgggagacgagagagaagaagattgtcggaagatggatcgtgaaagtggacattaagaactgctttccaagtgtaaagatcaaggtcttgaaaaacatgttcgaagatatcttcactggaacactgtatgcatatggggtggataatccagctgtgttttttgaattctgcgacatacttatcaagttgaccacacacaagggtggccttatccagggcgcaccgacctcaccttatctcaccaacttagttatttcctgggcgggaattgtagatgacctcgagcactactgtaatacacgccatggctacgatctgatctttagcatttacgccgacgacatcaccgttagccccaccatcaccaataaagcgagcgtcaaaaagataatccacgccattgagaaaagtaggattttcagggtgaaccctaagaagactactcagaatgacaatcgacataggagccatagaatcactggtatgtcaatccaccaggagtttgaccaattcggaccgtctgaagcctggactacgctgtcccggaaaaaacaaaagttttatcggggccgaatacagaaggtgattcaattcctacagcagggatgtgaaccttcgatcaaagagcacggcgtgtctattaaccaggctcgtgggtacattacctggacaaggcatgtttgtggtgaacggataccctcctgcctgaaaaaagtgatcgcagtgtttgaagagcttgttaataagcaagccttgtga

SEQ ID NO: 14492 - RNA, 1101 nt, unidentified
  source 1..1101: mol_type = other RNA; note = synthetic construct
atgaaaaatagcaagtactacctgtcattgttcctgaagtttctcccaattcttgagaagatgaaaattacttctgctatggctgatggactcatttacacttattataccaaggagccgtactatcgcacctacgagattcttgaaaagaatgggaagatccgtaaaatcgacgaaccttgtgatgctctcaaattgatacagcaggagctgaatcgctacttttataggttccccactcacaaatccctgaaggcttatattgagaactgcgaaggcgcaaaagagacagccctgactcatcagttcactgtgtggggggccaaacccggcgatagacaatctaaaccacctagatggttgcttaaaatggacctgaaagactttttcccctcaataaagacaagaacagtggagaacgttctgttcctcaattttttaagggacaaggataatcagcaactgctgatccgtctttccgaaaagctgaacaagaagttcgggttgctgttcaagcaatttattgagcttctcatatggctgaccgcagggaacggatgcctcacacagggtgcccccacctccccatatctagcgaatctagtatggaccgaaagcggtgtgatcgagaagattcttgactacctccacagccggaagaaggaatttaatttagcaatctacgccgacgatatctcggtcagtttcctcgaacgaaagtacccacgcggagtgattaaaaacattgccaagatcatcaatgacagtgagtacttcaaaataaaccctaagaaaaccaagctgaaccggctgaaacatggcgcccacctggtggtgggtattagcataggcaagacatctcactttgaaccttcctttggcatcccacagaagtttattaacacactgcgaggcgaactacacaagaccattaccatcataaaaacggagacgcggcctatcgagcagatccatgaggttagcatccccatgatgagagggaaaatcggatgggtcaagagtgtctatggagatcggaggttgccgtcaaaaattaagaaactggtagaggaattcgaaatcttatctaggatcatctga

SEQ ID NO: 14493 - RNA, 1278 nt, unidentified
  source 1..1278: mol_type = other RNA; note = synthetic construct
atggcgaggccaacggccctcgatgtgctgtcagcactgataggcctggataggcaaatcatcgaacttgcactgtcagagactgaaagctaccagaaaattgaaattccaaaacggaacaatggacggcgcatcatccacatcccaagcgaaattctagctctggtccaaaaatacttgctcgagtgcctgtattcctgggaggtccatgactacatgcacggatgtgtgataggaagaagtccagtgagcaacgcggccaaacatctgcgcctcaataagaaagagaatgtccgtccaggcactggcgaacagttcctgtatatgaccgtgcctaggcacgttctcaagctcgacctcagcaatgctttccacgcagtgactaaggacgccgtccaccagatgttaacatctgccttatctagcacatgggcggccaatctccacttgaagcaaggcgacacggatgtagagaaaaagagatgggatattatcaaccacgtaaggtctaacggctattttgtggagcccttggccagcctaattacccagctgaccaccaccgagggccttttaccgcagggagcggccacttcaccctatctcctgaacatggtcatatgcgcttcgggccttatggagcgcgtggcaaaagcctgtaagccgcggagaggacggttcacagtgtacgtggacgacattactattagtaccaaggagcctgaaattggtgaagggttcatcgccgctatgatcgaagccgttgagcgaggggggcggtttacggtgaatcccaaaaagaccagtcttacagattctagacaccgcgctcctgtaatcactggcgtgacattgggtaccaatgcagacgggactggtcgtcttagtatagaacaatcccatctgaacaccatcagacgcattctgtggtgtgctgccaacctgttagagcaggggatcaagcccgactttgatgaacacggattttccttggaccatgctctgggccatgccgcatgggtggataatgtttaccaggacaaagccccccatccactggtcgctaagcctctggcacgattcaggaaggcatttctctgccgagccctcggacctttggggacacaactgtccctgccctttggtgaggaacagcctaagcaggggctaagatcctcaaacaggcggcagctgctgcaggagctgttggatcagcttcttgaccgccccgttgaggagagaatcagggctatagatgagttcaacacacagcattga

SEQ ID NO: 14494 - RNA, 1032 nt, unidentified
  source 1..1032: mol_type = other RNA; note = synthetic construct
atgcagaagtctcggaaggatgctgtagagattttggccaacttgatgagactgcaatccgatttcatattcgacgctctaaagaaccggaactaccaacaaatcctaatcccgaagcgtagcggggatgttcgcaaactccacgccccaggggaagaactgaagcttgtgcaggaggtcatcttacagttcctctacagatggaaggtggacgccagacagttcggattcgtgctgggcggctctcctatccggaatgccaaatatcatattaggaacgagttctatgtccctcactgggtcctgaaactcgaccttgaaaatgcattcccttcagttacatcgacagtgcttaggaaggagtacacacgagttttcaaccccgagacatttaaagaactgagcggcatcgatgaaaaacagtttaccgcctttattcagctcatgctggatctgactacatatcgcgagagattgccacaggggagtccctgcagcccctacctgctcaatctggttctcgtgtggacgggggtcaccaagggtgtgctggaatattgtgaaaaaaaaggcctcagagcttcattgtatggagacgattttactatctctgcaaagacctcaaacatgtggttctccaaaacctttttcaggaagattaacagtgcggtcagtcgaagcggttgtctgcggttaaatcacgataagacccatctgatctgctcccgcaactctgctcctataattactggcgtgaaaatcactgagtcccacgacaatggcgcaaagctgaccttgacccaaagcactttaaatcactggcgaggggtgattcatcgcgtcacggagatactgtactggaacaatcggcttccacggctagaacaggacggagtgacatttaatcaggccctgggttacgtgaactggattgaggacgtatacagggagtcagaggtacccctttctgtgagaaagccaatcaagtcctttaaagtgcagagcagtaggtttgacaggcgtcgcggatga

SEQ ID NO: 14495 - RNA, 1200 nt, unidentified
  source 1..1200: mol_type = other RNA; note = synthetic construct
atgtcccgtaagcaggatgaggtgaagataaaaaacccctttccagctcagccattgttacagcccagaaccctcacaaagatctacaaagagcggagagacgaaatggacgccctggatttcttaggccacatcgtcaaggatcgtcagactatccaggaggcctggcgaattcgcagagagtacaaggatgtgtatgtgctaaagggcaacggagaagtccggatcctgtcagtcccgcctatcaaggttaaaaaggcacagaagatgatactcgagtggttgcgcgacgggaattttatatcctcccacccacgcatccacggcttagtggggagtagctgtttcaactttatcaaaggccactgtgggacctcgcaatatttctacagctttgacataaaacacgcttatgacagtactcctgtgcctctcatctatgaaaaccttctgaggattttgagtaacaaagagtcgctgctgctccgcgcatacttcgaatctgagacgggaaaggggatccaggaactagccaaaaccattatcgagttgactacctactcccaagcgtcacctaaacgaacagaaaacgagaagcagctttccttcctgaaaaggggctccaactcaattctgccccaaggtgcgcctacaagccccgcactcttcttcgttgtgcttaagacaatgatggagaagattgaacgtgatgtaaacttgagcgaacataaactgagctgttatggggacaatttcctgatttcttctcccagtccaattaatcccgaggtagccgaccatgttcttgctatcgtgaaatcatttgggtttaccccccataaaacctttcagcataatattaagcagggcgccctgaaaatctgtggatataccatcgccccaggtaatggtggtaaggataaaacgcgaatcggaattgacaaaagcaccattcggaggatacgcgccctgtgctgcaaggcacaatacactacacgctacaaggatccgcggctctacagaaggctacagggctgcctggcttggattactccagtctatggaggaaatcggcacaatctgccaaatcagatcaagaagcctcttagaaagattggcacacctctgaagtgccagtctaaacagagcaagaggtctttcctgctcaagaaacaaaggcccaagaaaagacgggcttga

SEQ ID NO: 14496 - RNA, 1047 nt, unidentified
  source 1..1047: mol_type = other RNA; note = synthetic construct
atgaggcagacacggatagatgaatggtttagcgagacgaagcagaagaagaagctcatcgctaaaattcaaaaggtgtccgccttaaccaagaccaggcccgagtcattttgggaaaagttggagaaagccctgcctctacgaaaagactacagagaggctaaaatccctaagagatctggtggatatagaaccatctacatgccttctccagagctgaaaaaggtacagaaaaatatcctccgctatctgcaggaaatatggcaagtacattatggaccggtgcacggtttatcccccggtggcagctgcgtgaagcatgcacgcatacacagcgcctcgcggtggatttttcagttcgatataaaaaacgcgttcccatctacaaacattataaccctgcggaaactactctcacagatcatccccgtggaggtgaatctcggcgagaacgccactaagattgcctacactcgggctgagcttatcattaagcttaccacttttcaggaaggcctgcctcagggggcacccactagtcctttcttgttctacatcgtgctgacatctaggaagattattccagctacaactgggggcgaaattagacttaccgggctgttctataaactgtggtccgcgtgtccccgaggctacaagatttcctgctacgtcgacggcttcgttatatcagggcccaagcccatcagccctaaaacccaggaaaaaatcttcaaaacgatccgaaaggagagtttcgaaatcaatcagaagaagacacgcattcaggactgccgccacggaaccgttatgatctgtgggctggccgtcgacggaaaagggcgtattagtctccctaagaagacgattcgtaagtggcggggcatcatcggaaaagcaagatttgatccggagaacttggaattgaggcaaaagattgagggctttgtcgcaagcctgaaaccaatctacgaaaaaggaaccccaccgcagatcacaaagccatataataggtatcaacgcgagctggttaaaactacatcctga

SEQ ID NO: 14497 - RNA, 1101 nt, unidentified
  source 1..1101: mol_type = other RNA; note = synthetic construct
atgaaaaagttttcctcctttgatggtctgttgtctctcctcgaggactgtagacaatgcgaaatcaagtaccggatcaaaaagatgcctaaaaaaggcgggagcaagcggattatccacgtgccctccaaggaggtaaaagaaattcaatgggagatactggacatcgttaaagcctggcaggtggatgaatgccagtttggcttcagtccaggcaagtcctgtgtcgataacgccctcttccacatccatggctatgatatcaatgcctctggtcgaaagattcaaatcaggggagttcccaggtgggtgctgaaaacggacatcgaggacgctttcccaagcgtgaaacgaaagcatctggagacactgtttcgtgacctatttctgcccctaaaatcctaccctgcatttgtcagcgcgacttcacccgacagggtcgacaagatttacaagaagctggtgtatcagttcgctagactggccacctttaaggggcgcatgcctcaggggagtccttgctcaccctatttattcaatctcgtcttacttcagagcggcatcgtgaaaaagctgaaggataaagcaggagagcgggccaaaaagacaaagggttgtcaggttactgcttataaaatcagcttctacggtgacgatataaccgtgacctcttttaaggaccgcataccaaaccgcttcattaaggagatatcagccattgttgaagaaggcgggattttccggcttaacaatgagaaaacacagagatcttcaaaaaagtaccgatcgatcctcattaatggcatcaccttgaatgataaatggaaggaaggaggaccgtgcttcttgggattgagtaaaaagatacgtaagacctacagggggaagattcacagagtgacagtgatcttagatagcgggcgccttccagaacttgagattgacggcattaacctggagaaagctatgggaatcatttctcggataaaggacgtgtatagaaacgaaagtctgccttccgatctcgagcgcgtactgatcaagttccaggaggcaagaaataacctgatcaggaggactatcaacatcgtctgtatttga

SEQ ID NO: 14498 - RNA, 1251 nt, unidentified
  source 1..1251: mol_type = other RNA; note = synthetic construct
atgtggatttcacaggacctgatcgaaaaaaccaaggaagccctgtatgagaaaactaaggatgagagggtgctatgggctagccccttggaaattgtgtgccttgccaagcaaaagaagtgtaaggttgactttaacacgcttctgagatcgttcagcgcgaatcactgcacggcagaggacgtggcaaatctgttcaattatctcaatagtcatggggaggggaatgtggagcgtgaaatgctccttaaggtcatagctgagccagaggagaggaaagtcctgcaggaagtgaagtgtctgatcgacagatactatccaaagcgaaagaagaaccccttagaggggataccgaaaattaaacagtttgtgaccaggttccggaacaaagagcgtcactacagatcttttgccattccaaagaggaatggcggacgccgcatcattgaagcacctactcaggaattggccaacatccaaagattgattctgaaaaagatcctctatcggaaccagatctggaactccaacagtagcgtgcatgggttcgtccctggacgcaatatcctctcaaacgcgagtcttcataaagaggcaaccgttatcgtcagaatcgatcttaaagacgcctttaggaataccaaggaagagatgttggtgaagcacctaaaggagtactttactgaaaaaggcgctaagatcctagtgcgcttatgcacatacaaaggacatctccctcagggggcccctagctcaggcatgctcctgaatttcgtactgggagaactggatggtaagctgaaaaaaattgccgggttcatgggctggcgttacagtagatacgccgatgatttaactttctcctgtgtggaattcaataaacacacagtaggcattggcaagctcatagaaagagtgaaatctatgatcaaagactactcatatcgggtcaatgaagagaaaatccgggttttcaaaaaaaatcgcgccatgcgagtgacaggcctcgtactgaactctggtaagcccaccatcagccggaagtttaggcggaacgtcagggctaaggttcacaactttgttaccaagggtattggaaacgagaaggaggtgctgggatatatttcctatatcaacctggcgaacaagaaatacgctaaaaagctgttgcgaatgatggagaagctgccctccacacacgtaccacgccaggatgctataggcataagctccggtgtcgcatctgagtga

SEQ ID NO: 14499 - RNA, 195 nt, unidentified
  source 1..195: mol_type = other RNA; note = Related to NC_015164.1; note = Phocaeicola salanitronis
gctgaaacggaattttgaatttcgtccggcgtatttgcccggatgtctccttgttcttcggaatcatggagataaacaatgttagtacgttaacgtattgcactgtagtacgttgtacttttactatattattatgatgatattttatatgttgtatattatattttatattacataaagaaaagacatttcagc

SEQ ID NO: 14500 - RNA, 182 nt, unidentified
  source 1..182: mol_type = other RNA; note = Related to JAFSKF010000035.1; note = Bacteroidales bacterium
actgaaacggcattttgaatttcgtccggcgtatttgccggatgtctcctcgttcttcggaatcttggagataaacaatgttagtacgttaacgtgttgcactgtagtacgttgtacttttactatattgttattatgctattttatatgttatatattacataaagaaaagaagtttcagc

SEQ ID NO: 14501 - RNA, 191 nt, unidentified
  source 1..191: mol_type = other RNA; note = Related to JAFZXH010000011.1; note = Bacteroidaceae bacterium
actgaagcggcattttgaatttcgtccggcgtatttgtccggatgtctccatgttcttcggaatcctggagataaacaatgttagtgcgtcaacgtgttgcactgtagtacgttgtactttttactatattgttatcatgctattttatctattgtatgttgtacattacataaagaaaagaagtttcagc

SEQ ID NO: 14502 - RNA, 191 nt, unidentified
  source 1..191: mol_type = other RNA; note = Related to NZ_KQ957209.1; note = Prevotella corporis
actgaaacggtattttgaaattcgtccggcgtatttgaccggatgtctccttgttcctcggaatcttggagataaacaatgttagtacgttaacgtgttgcactgtagtacgttgtacttttactattattgttatatgtagtttttctatgttatatgttctatattacataaagaaaagatgtttcggt

SEQ ID NO: 14503 - RNA, 186 nt, unidentified
  source 1..186: mol_type = other RNA; note = Bacteroidales bacterium; note = Related to JAFWZP010000094.1
gctaaaatagcattttgaattttgtccagcgtatttgtctggatgtttcctcgttcttcggaatcttggaaataaacaaagttagtatgttaatgtgtacactggaatgtgttatacttttactattgttattatgatattttctattttgtattttttaattacataaagaaaagaaattttggc

SEQ ID NO: 14504 - RNA, 179 nt, unidentified
  source 1..179: mol_type = other RNA; note = Bacteroidales bacterium; note = Related to JAFSTV010000046.1
gttgaaacggcattttgattctgtccagcgtattcgcgggatgtctttgttcgccttaggcgtgacgaagataacaatgtcatttcgtaaactagtcttggaagagactttcttattatgattaatgactatattttattattttttattctttttacataaagaaaagaagttttagc

SEQ ID NO: 14505 - RNA, 225 nt, unidentified
  source 1..225: mol_type = other RNA; note = Related to VVZB01000003.1; note = Phocaeicola dorei
accgagatgtcatttgatttttgtccagcgtggtgcaaaccctgctctcgcaagagagtggattcgcgggatatctcttcgcttgccgaggagacgataatgttagtacgttaacgtgataacactgtagtacgatgtactttctattattcatattttatgactttatatatttatattgtctattattattttattctttacataaagaaaggacgttttggt

SEQ ID NO: 14506 - RNA, 227 nt, unidentified
  source 1..227: mol_type = other RNA; note = Related to NZ_JADNRM010000003.1; note = Phocaeicola sp.
gccaaaatgttatttgactttttgtccggcgtggtgcaaaccctattttcgcaagagaatagattcgctggatatctcttcgcttgacggggagacgataatgttagtacgttaacgtgataacactttatacgatgtactttctattttttttgtttttatgttttatgactttatatatttatattgtctattattttttttacataaagaaaagacgttttggt

SEQ ID NO: 14507 - RNA, 207 nt, unidentified
  source 1..207: mol_type = other RNA; note = Myoviridae sp.; note = Related to BK014950.1
actgaaacatcatttgaacttttgttcggcgtggtgcaaaccctactcttgaaagagagtagattcgctggatatctcctcgcttgccgaggggacggcaatgttagtacgttaacgtgataacactgtattttctattatttatattatttgaatttatagtatttatagtattgtagtttttacataaagaaaagacgttttggt

SEQ ID NO: 14508 - RNA, 205 nt, unidentified
  source 1..205: mol_type = other RNA; note = Related to JAFWQO010000014.1; note = Prevotella sp.
tctgaatcggcattttgaatttcgtccggcgtggcttcagccctgctctttcgggagtagattcgctggatgtctccctgctcttcggagtatgcaggagataacaatgtcaggcagttaacgtgatactgatgtacttacgtactgtttctattatttattatggtatttattttattattacataaagaaaagaagtttcaga

SEQ ID NO: 14509 - RNA, 192 nt, unidentified
  source 1..192: mol_type = other RNA; note = Related to FNHC01000010.1; note = Prevotella bryantii
actggaactacattttgaacttcgtcctgcgtattcgcaagatgtctcattgtccttcgggactttgagataaacaatgtcattacgttaacgtatacactaggcatacacagtatgctgttcttgttatgttatgatgtatttatgttatatattatatgttatatttacataaagaaaatcgtttcaggt

SEQ ID NO: 14510 - RNA, 190 nt, unidentified
  source 1..190: mol_type = other RNA; note = Related to NZ_JNLA01000055.1; note = Bacteroides sp.
tctggaactacattttgaactttgtcctgcgtattcgcaagatgtctcactgccctttgaggctctgagataaacaatgtcatcatgttaacgtgtacactatacatacatggtatgtttttattgtagatgttatgatgttattatcttagattctatgttatacttacataaagaaaatcgtttcaga

SEQ ID NO: 14511 - RNA, 213 nt, unidentified
  source 1..213: mol_type = other RNA; note = Bacteroidaceae bacterium; note = Related to JAGBTN010000007.1
ctggaattacattttgaaccttcgtccagcgtggcataagccctgccttatcaggtagattcgcaggatgtcttcttgttctaaggaacctgaagataaacaatgttatcacgttaacgttgatacttgacatactatgtatgtttttattgtttttatgttatatattatttatcatatttagtgtatttacataaagaaaagacattccaa

SEQ ID NO: 14512 - RNA, 173 nt, unidentified
  source 1..173: mol_type = other RNA; note = Related to FR901644.1; note = Prevotella sp.
agtggacataaatttgaactcgtccgatgtattcgtcggatgtcacctgtcttagtactggtgataaacaatgttatagagtaaacgttgaaaacttgtatgttgtcaattgttttattgtatttattgtatatttttatgttgtatatttacataaagaaatgaactccgct

SEQ ID NO: 14513 - RNA, 203 nt, unidentified
  source 1..203: mol_type = other RNA; note = Related to JAGAGC010000402.1; note = Aeriscardovia sp.
actgaaactacattttgaatacgtcctgcgcattcgcaagatgtcttccaacccttcggggttgtgaagataaacaatgttactcggttaacgtgaaacttgaagtacgttgtacttatttctatattattgatataaatagccatccatatatcttaatagccatttatatcatgccgttagataaggaaaatacttttggt

SEQ ID NO: 14514 - RNA, 203 nt, unidentified
  source 1..203: mol_type = other RNA; note = Related to NZ_JACJJF010000108.1; note = Bacteroides gallinaceum
ctgaaactacattttgaacttcgtcttgcgtggcgtaagccctgctctttcgggagtggattcgcgggatgtcttcttgctcatctgggcttgaagataacaatgtctgtccgtgaaagctaacattgtttatggcactaactccatcttagattttgatatacttatatagatggatttacataaagaaaagaacgtttcag

SEQ ID NO: 14515 - RNA, 203 nt, unidentified
  source 1..203: mol_type = other RNA; note = Candidatus Avibacteroides faecavium; note = Related to DVLS01000070.1
gccgggatacattttgaactttcgtcctgcgtggcctcgtgccctgcccctcggggtggattcgcgggatgtcccctcgccctctggggcttggggatgacaatgtctgattgtcattagttttacctcatttaaataactttaaaaagttgtatttagaggtatctagagttatttcatacataaagaaaagacgttccggc

SEQ ID NO: 14516 - RNA, 217 nt, unidentified
  source 1..217: mol_type = other RNA; note = Related to NZ_JACICA010000001.1; note = Alloprevotella rava
ggcagacataaatttgaattcgtcttgcgggtgaaagccatgctttcttttaagaaggtatattcgcatgatgtctcattatctttcgggatatagagataacaatgttatcacgttaacgtagacttgcacatacgttgtatgtgctttctattgtgttatgttgtttttatatttaatagtcttattttcttatataaagaaatgaatgtctgtc

SEQ ID NO: 14517 - RNA, 209 nt, unidentified
  source 1..209: mol_type = other RNA; note = Related to JXQI01000021.1; note = Prevotella sp.
gacagatataaatttgaaaacgtcttgcgggcgaaagccctgtctctttggagacagattcgcatgatgtctcatcgtctttacggccggtgggataatgttatcacgttaacgtagacttcacatacgtagtatgtcttctactcgtgtcttattgttttatatttgtattcttattttattattatataaagaaatgaaagtctgtc

SEQ ID NO: 14518 - RNA, 209 nt, unidentified
  source 1..209: mol_type = other RNA; note = Related to HF986315.1; note = Bacteroides sp.
gacaggtataaatttgaacacgtcttgcgggcgcaagccatatttccccggagatacattcgcaagatgtctctaggctttttcaaagccctgagatgacaacgtcatcatgttaacgtagactgtgcatacgcagtatgcctttctatcctgtattgttgtattgtttttatagtattattccttatataaagaaatcaactcctgtc

SEQ ID NO: 14519 - RNA, 206 nt, unidentified
  source 1..206: mol_type = other RNA; note = Muribaculaceae bacterium; note = Related to JAFULJ010000027.1
aactgaactaaaatttgattcaagtcttgcgtattcagcatgacggcttcttctgcagaagaagtaacccaatgttatttggttaacggcgggcttgagtagacaagtctactaatttataaatttataatcaactcaagacttcaatcttaagacttataaatttaagactaacatattaattataaaagaaattatgttcagtt

SEQ ID NO: 14520 - RNA, 234 nt, unidentified
  source 1..234: mol_type = other RNA; note = Related to JAFRQB010000001.1; note = Prevotella sp.
actgaaatggcattttgaattatgtcttgcgtggtacaagccctacttcttaagaggtagattcgcaagatatcttcagtctcctcggagttctgaagagaaacaatgtctccatgttaacgttacactatttcgtacgtagtacattgttattgttttgtcgaacaagccttttattcataaaaggtattgtttttatctattcatacttatacaaagaaaagacatttcagt

SEQ ID NO: 14521 - RNA, 223 nt, unidentified
  source 1..223: mol_type = other RNA; note = Muribaculaceae bacterium; note = Related to JAFQZK010000038.1
gctgaaaagccattttgaactttgtcctgcgcattcgcgggatgtccataattccctttgggagttgtggataacaatgttaggcgtgttaacgttcaactgcgtttcactgatgtactgcgtacattgtattatttttagtgattatgatcattatgattatttagatcattatgattatttagatcattgctatattttctgaaagaaaaggctttttagt

SEQ ID NO: 14522 - RNA, 185 nt, unidentified
  source 1..185: mol_type = other RNA; note = Bacteroidales bacterium; note = Related to JAFXWY010000545.1
acctgaaacgatattttgatttcgtcctgcgtattcgcaagatgtccttacgcttccgaaaggaagtaaagggataacaatgttattcggtaatcggatcagcattcatatctatttttatatttatatctgtatcggtatttatatctatacatttatatattattaaggaaaatttgtttcgt

SEQ ID NO: 14523 - RNA, 216 nt, unidentified
  source 1..216: mol_type = other RNA; note = Related to RKEV01000037.1; note = Prevotella sp.
agcggatataaatttgattccgtcatgcgtggtgaaagccctggctcttcggaggcagattcgtatgatgtctctttgactcgtaagaggctttgagataacaatgttatatcgtcaacgtagactgtagacatacgcagtatgtcctttctatcgtataatgttgtatatattaatgtttatatgtagttttatataaagaaatgatgctccgca

SEQ ID NO: 14524 - RNA, 176 nt, unidentified
  source 1..176: mol_type = other RNA; note = Bacteroidales bacterium; note = Related to JAFXTE010000053.1
accgaaaatgtattttgaaaccgtccggcgtggctttgccctgcagtagcagattcgcgggatgtcccattctatgaatagggatactaatgttagaatgttatcgtatgattcgtatattcgtatatcgtgatcgtgtgactatattgttgtaaataaagaaaagcagtttcggt

SEQ ID NO: 14525 - RNA, 237 nt, unidentified
  source 1..237: mol_type = other RNA; note = Related to NZ_KV793777.1; note = Porphyromonas sp.
agggacataaatttgacttcgtcctgcgggcttaggccgcacctctccggaggtgtattcgcaagatgtctcagactcccctcggggatatgagatagccaatgtttgatcgtgacgatctattttcatatccacgagagaacatccttatttaggggttagatatcctctttcatgatctatttagatgagggtattttattttccgctcacatacataaagaaatgagtgtcctc

SEQ ID NO: 14526 - RNA, 225 nt, unidentified
  source 1..225: mol_type = other RNA; note = Muribaculaceae bacterium; note = Related to JAEUGO010000081.1
gtcgaagcagacattttgaaaatgcccgacgaattgccgggtacttctccctccggggagacttccaatggtcaattggcttctgtgcgattaccgtgtctacttgcggtgcagtggctcctcatccgacaagtcaatcgctttgaatgtacagatttaacaatcaatgattatgaaatctgtattatgaaggtcttacagacataaagaaaacaacgcttcggc

SEQ ID NO: 14527 - RNA, 225 nt, unidentified
  source 1..225: mol_type = other RNA; note = Muribaculaceae bacterium Isolate-102 (HZI); note = Related to RIBI01000006.1
atcgatgcagacattttgaaaatgcccgacgaattgccgggtacttctcccctcggggggacttccaatggtcaattggcttctatgcgattaccgtgtctacttgcggtgcagtggctcctcatccgacaagttaatcgcgatgaatgtacagatttaacaatcaatgattatgaaatctgtatcatgaaggtctcataagacattagaaaactacgcatcgac

SEQ ID NO: 14528 - RNA, 225 nt, unidentified
  source 1..225: mol_type = other RNA; note = Siphoviridae sp.; note = Related to BK020991.1
gacgaagcagacattttgaacatgcccgacgaattgccgggtatttctccctcggggagatctccaatggtcaattggcttctatgcgattaccgtgtctccttgcggtgcagtggctcctcatccgacaagttaatcgccttgaatgtacagatttaacaatcaatgattatgaaatctgtattatgaaggtcttaaaagacataaagaaaactacgtttcggt

SEQ ID NO: 14529 - RNA, 221 nt, unidentified
  source 1..221: mol_type = other RNA; note = Related to JAGAST010000027.1; note = Muribaculaceae bacterium
gctgaagcagacatttgaacttgcccgacgaattgccgggtactttcccgaaagggaatttccaatggtcaattggcttcctgctgttaacttgcctccttgcggtgcagtggctcctcatacagcaatttagcagccaagaatatcagatttaataataagataattatgaaatctgaaaattgaaggtcttacaagacataaagaaacgaagcttcagc

SEQ ID NO: 14530 - RNA, 201 nt, unidentified
  source 1..201: mol_type = other RNA; note = Related to VULT01000011.1; note = Sodaliphilus pleomorphus
ggctaaagaaacattttgaacctgcccggcgattggtcgggtactttcccctcggggaatttccaacggtcagttggctctgggcacttatcacatcatcaagctgatgtgatagtgcgtatgaatctgggaaaattacaccctcctatgtcatagagttaatttctcagccaaagcgaaacaaagaaaatagtcttggcc

SEQ ID NO: 14531 - RNA, 219 nt, unidentified
  source 1..219: mol_type = other RNA; note = Related to JAAVDT010000061.1; note = Bacteroides sp.
agtcaaggggacattttgaaattgcccgacgatttgtcgggtactttccccacggggaatttccaacgttctgttggctcctgcgcacttatcgcatctacttgcggtgcagtggctcctcatccgatgagataagtgcccatgaatctgggatgataagatttatgatattatagtcaattactcagacttagggacataaagaaaacagccttggct

SEQ ID NO: 14532 - RNA, 222 nt, unidentified
  source 1..222: mol_type = other RNA; note = Related to JAAVCQ010000011.1; note = Bacteroides sp.
agtcaaggggacattttgaacttgctcgacgatttgtcgggtactttcccctcggggaatttccaacgttctgttggctcctacgcacttctcgcatctacttgcggtgcagtggctcctcatccgatgagataagtgccgatgaatctgggaagatgataagatttataatcttatagccaattactcagacttagggacataaagaaaacaaccttggct

SEQ ID NO: 14533 - RNA, 172 nt, unidentified
  source 1..172: mol_type = other RNA; note = Related to NZ_CP007034.1; note = Barnesiella viscericola
tcttaatgaaatgaatttgattcccgcctggcgtttagttcaggtgtcctaagcgaaagcttttggatatacaatgttagagttgtaattgtttcactattttgtcataatttgacgggtgatatttttttaagtatatagtgtacataaataaagaaataagtagttaagg

SEQ ID NO: 14534 - RNA, 173 nt, unidentified
  source 1..173: mol_type = other RNA; note = Related to NPIZ01000015.1; note = Prevotella sp.
cttgacgaaataaatttgactaccgcctggcgtttagttcaggtgtcctgagcgaaagcttttggatatacaatgttagagttgtaattgtttcactgttttagtcatattatgttatatgatgtgattatagtattatgtagtgtacatatataaagaaataagtagttggg

SEQ ID NO: 14535 - RNA, 174 nt, unidentified
  source 1..174: mol_type = other RNA; note = Bacteroidaceae bacterium; note = Related to JAFRTY010000007.1
cctaactaaatgaatttgactttcgcctgacgtttcgctcaggtgtccatagcgaaagcttttggatatgcaacgttagagttgtaattgtttcactatattttacaagatgtgttatgtagtattttatagtattatgtatattgtacatatataaagaaatgaatagttagc

SEQ ID NO: 14536 - RNA, 172 nt, unidentified
  source 1..172: mol_type = other RNA; note = Bacteroidaceae bacterium; note = Related to JAFXXQ010000016.1
cctgacttaatgaatttgacttccgcctgacgtttagttcaggtgtccagagcgaaagcttttggatatacaatgttagagttgtaattgtttcactgaattattcatgtgttgtactttgttattgtgttattatgtatattatgcatatataaagaaatgaaaagtcagc

SEQ ID NO: 14537 - RNA, 173 nt, unidentified
  source 1..173: mol_type = other RNA; note = Related to JABZTC010000018.1; note = Prevotella nanceiensis
tttggtacataaatttgatttagcctaacgttttgtttaggtgtccattgcgcaagctttggataagcaatgtcagggcagtaattgttttactattttttaacattgtgaaagtattatgatattgtttatattattgtatttttacataaataaagaaataaagtacctaa

SEQ ID NO: 14538 - RNA, 159 nt, unidentified
  source 1..159: mol_type = other RNA; note = Related to JABVZU010000003.1; note = Phocaeicola sartorii
atgaaatagaaattttgaattagtccggcgtatttgtccggatgtccccaccttggtagggaaaacaaggtttatttgtcattctccgcgtgctccgtgtaccttgaacgttttgcgtgctccgggggcgtgggcatatacaaagaaaatgaattttat

SEQ ID NO: 14539 - RNA, 242 nt, unidentified
  source 1..242: mol_type = other RNA; note = Related to JAFXAS010000015.1; note = Alistipes sp.
attgaaatgacattttgatttaggttcgcgtattgcgtaaccagcccgacgaaggtaacttcacagggttaagcaaggttttgctgtcataattatatcctgacatcgagctgtcagtgctataattttttagtaaatctatattgcatatagattagaacttatttgagttttaataaagatatagatgagaataatattaagtttaatattattcatagacaaagaaaagagatttcaat

SEQ ID NO: 14540 - RNA, 325 nt, unidentified
  source 1..325: mol_type = other RNA; note = Related to JAFTUI010000023.1; note = Proposed Tidjanibacter sp.
attgaaatgacattttgatttaggctgtcgtattgtacagctggcccaaaggaggtaacttcaatgggtaaaccaaggtcttgttgttattggacttttgaccgacagttcctgtctgttaaaagtcaagtattctcaataaattgagaacatattaacttaagaagttaatattaaataacaacatatcccttcttcgaagtgatatgggtgatattcaagtctgaacttgaatatcattaagcaaaatactccgtattttgcgtcaagtgagaataattaaactgcgtttacttattcatagacaaagaaaagaaatttcaat

SEQ ID NO: 14541 - RNA, 212 nt, unidentified
  source 1..212: mol_type = other RNA; note = Related to JAFNYI010000087.1; note = Alistipes sp.
attgaaacgacattttgacttaggttgtcgtgttgtacaaccgactcttggacccgtctaagagtaaacaaatggcttactgtaattcgtattttgacaatgctcgggcattgcacaaaatacaagtactcttcgagtatctcctacaaccatttatgtttcgtttatttgagaatagttcctattcatagacaaagaaaatatgtttcgat

SEQ ID NO: 14542 - RNA, 164 nt, unidentified
  source 1..164: mol_type = other RNA; note = Bacteroidaceae bacterium; note = Related to JAFUSZ010000030.1
acaaaaccaattttgaaactgtctgccgtattcagcagattcctcttgctttgcaggaggtggcaatgtttgatcgttataggagttactgctctatattgacgtgcaaatgatgcatattgacatgcaaatgattcttcatatacaaagaaaagcggttttgt

SEQ ID NO: 14543 - RNA, 186 nt, unidentified
  source 1..186: mol_type = other RNA; note = Related to SUYG01000053.1; note = Prevotella sp.
acagaactgattttgaaattgtctaccgtattcagtagattcctcttgcatatgcttgaggtaacaatgttagattgttatatgtgcttgacgtgcaaagcatacttctgctttccttcgaggcttacaaatttaaatacaaacagtatgttatgtgctatgatatacaaagaaaagcagttctgt

SEQ ID NO: 14544 - RNA, 148 nt, unidentified
  source 1..148: mol_type = other RNA; note = Lentimicrobiaceae bacterium; note = Related to SUWU01000046.1
actgggagagcattttgaatttgttagatgtattcgtctaatatcaaaacaatgttgctattgttatttgaaactagtctttgaaactagtctatagaatattataattgctaaatctaggagcatgtttgaagaaaagaatctcagt

SEQ ID NO: 14545 - RNA, 149 nt, unidentified
  source 1..149: mol_type = other RNA; note = Related to JAFUDU010000007.1; note = Prevotella sp.
atgtgagacaaattttgactaccgtccggcgtatttgtccggatgtccctctcaagagggataggttcgtatcattgtcattccgtttaccgtgttcgctggcgttctcgttctgcgttctcgtgtatatacaaagaaaatcctcatgt

SEQ ID NO: 14546 - RNA, 234 nt, unidentified
  source 1..234: mol_type = other RNA; note = Related to JAFRXO010000051.1; note = Bacteroidales bacterium
actggaggagacttttgactttgtccgtcatatttgacggatgtcccgaaagaagggataagagaatgtttgtgcgttacttgcaacaaagtccgatctccctagatcgtctttgtttcatattgagtaaactcaatatattctattttagccggtcataaatgaccggtcgccctacttcccctcctttgtcgattccgacaaagggtgtacacaaagaaaacgatctccagt

SEQ ID NO: 14547 - RNA, 237 nt, unidentified
  source 1..237: mol_type = other RNA; note = Bacteroidales bacterium; note = Related to JAFQZW010000007.1
accgaagcaaacttttgactttcgtctgtcatgtttgacagatgtccgtaaaatcggatactctaaaggtttactcgttactaggaagtgaaatcgcacatagtgctattccacttcagaaatgtgcaaagcacataaagtaaagcctaaacccttcaaattctagactaattaaattattagtcgacagagtcgacgatcgaacaaagttcgtagacaaagaaaacaaacttcggt

SEQ ID NO: 14548 - RNA, 205 nt, unidentified
  source 1..205: mol_type = other RNA; note = Bacteroidaceae bacterium; note = Related to JAFZZI010000013.1
accggagcggacttttgactttcgtctgtcacgtttgacagatgtccgtaaaatcggatacttccaaaggtttactcgttactcgagaagttttacttctccacatatgtgcaagcacatatgagtgatgagatctaaggaatatagttggaactatattccgggactctgacgagtccgtagacaaagaaaaaaacgctccggt

SEQ ID NO: 14549 - RNA, 220 nt, unidentified
  source 1..220: mol_type = other RNA; note = Paludibacteraceae bacterium; note = Related to JAFSJL010000028.1
accagagcaaacttttgattttcgtctgtcatgtttgacagatgtccgtaaaatcggatacttgaaaggtttgtatgttaccctgaagagcaacgacttacagtcctttctcttcataagatgtgcttcgcacattattatggcatattgagatcttagtatattgagactctgtatcccgaactctgcgagtccgtaaacaaagaaaacaagctctggt

SEQ ID NO: 14550 - RNA, 223 nt, unidentified
  source 1..223: mol_type = other RNA; note = Bacteroidales bacterium; note = Related to JAFUYF010000001.1
accggagcagacttttgacttcccgtccgtcatgcttgacggatgtccgggcaaccggacaacacaaaggtttacgcgttactggtcacaagccctgaaatcggagatttcacttcttgtgacttataatgtgacaagcacatttgtggttatatgtgttttattctattgcacgcaatagatcggaatctcgattccgtagacaaagaaaacgacctccggt

SEQ ID NO: 14551 - RNA, 230 nt, unidentified
  source 1..230: mol_type = other RNA; note = Bacteroidales bacterium; note = Related to JAFZME010000158.1
accggagcaaacttttgacttttgcccgtcacgattgacaggtgtccgggaaaccggacaacaccaatgtcgccgcgttacatcgatactgcgcttcaatctgcgatttcgcacagtatcaccatatgtgccttgcacattgagtgtatttatggctgtttagcgctaaggggcgctcaacagcgcagtctcttcgagcctgcattaatacaaagaaaacgaactccggt

SEQ ID NO: 14552 - RNA, 255 nt, unidentified
  source 1..255: mol_type = other RNA; note = Bacteroidales bacterium; note = Related to JAFUDT010000010.1
accgtagcaaacttttgattccagtctgtcatgcttgacagacagtccgggcaaccggataatcctaagggttttgcgttacagcacataactctgtcatcgtgccgatgccatcattctgtgcgattataattatctgaacgagttcagataattgaattaaaagtggaacttttaataggattgtaattgaaaaaaaacgtagtaatcctcttcgagtattactgtgtgtaaacaaagaaaacgaactacggc

SEQ ID NO: 14553 - RNA, 228 nt, unidentified
  source 1..228: mol_type = other RNA; note = Bacteroidales bacterium; note = Related to JAFYYM010000038.1
accggaacaaacttttgacttttgtctgtcatgtttgacagatgtccggctttcgccggaaaaaccaaagggttctgcgttacttcgccacaacgctgcactgcgttccgcattctggcggaatatgtgagcgatgctcacattgtgtggtgatgtatttacggatatagagattctctctctatcccgttctctgaagagaacgtatacaaagaaaacgagtccggt

SEQ ID NO: 14554 - RNA, 202 nt, unidentified
  source 1..202: mol_type = other RNA; note = Related to JAAYJQ010000010.1; note = Bacteroidales bacterium
atcggcctatgcttttgattcccgtccgtcatgtttgactgacttgcctgggcgaccaggcgttcaaaggtccattcgttactcggtgactgcgtcacgtcatattgcttcgcaattgagaaaaatggaactgttgtattattttctaaaaggattggcggaaagacttcgtcattccgtacacaaggaaaacagcgccggt

SEQ ID NO: 14555 - RNA, 234 nt, unidentified; identical to SEQ ID NO: 14546
  source 1..234: mol_type = other RNA; note = Bacteroidales bacterium; note = Related to JAFRXO010000051.1

SEQ ID NO: 14556 - RNA, 207 nt, unidentified
  source 1..207: mol_type = other RNA; note = Related to JAFYOT010000249.1; note = Bacteroidales bacterium
cctgaatcagattttgatcttccgtctgttgtattcgacagatatccaggtccgcctggatgagtaatgttatagcgtaacagtttcatctgaagctgaaacaatatatatattactatgtaatgaatataatattacacaatattatatattatttcagattaaacggtaacaagttacctgtacacaaagaaaagacgattcagg

SEQ ID NO: 14557 - RNA, 172 nt, unidentified
  source 1..172: mol_type = other RNA; note = Related to JAGBVU010000006.1; note = Bacteroidales bacterium
actagaataggattttgaatagccgtctgtcgtattcgatagatatccagtatactggatgaaaaatgtatcttcgtaatatgttgtatatatactttgtatgacattacatgtagtatgatatgttaaacggtaacaagttacctatacacaaagaaaagagaattctagt

SEQ ID NO: 14558 - RNA, 155 nt, unidentified
  source 1..155: mol_type = other RNA; note = Bacteroidales bacterium; note = Related to JAFZIR010000019.1
tctgaaatggcattttgaaaactgtctggcgtcttgccagatttccaggtcaaactggaaaagcaatgttagtgcgttattgttttaaggtgtttggatgagtttggatgttattatagtgatatatggcatatacaaagaaaacgaatttcaga

SEQ ID NO: 14559 - RNA, 183 nt, unidentified
  source 1..183: mol_type = other RNA; note = Related to NZ_CP091788.1; note = Prevotella sp.
acaggaatgaacttttgacttgtagcccgtcgtatttgacaggtggcctggtagcaatactgggtaagaacaatgttagattgttattatttcatatctgtgtgagtttttactagaacgacaagtagaagtagacaagaacacagacaagattttcatatacaaagaaaacgaagttcctga

SEQ ID NO: 14560 - RNA, 168 nt, unidentified
  source 1..168: mol_type = other RNA; note = Muribaculaceae bacterium; note = Related to JAFRRT010000017.1
atgtgaaacaaattttgaattctggtccgatgctactgtcggatgtcattcttctaaaaaaagaattgataaaccaaggttatattttattacagtctttgactgatttgtagagaacctcattttaaactgttcaagattacaaaaacaaagaaaaagagttcgcat

SEQ ID NO: 14561 - RNA, 161 nt, unidentified
  source 1..161: mol_type = other RNA; note = Paludibacteraceae bacterium; note = Related to JAGCXD010000267.1
atgcaaaacaaattttgaattctggtccgatgctatcgtcggatgtcattcttctaaaaaaagaattgataaaccaaggttatattttattacagtctttgactgatttgttgtgtatatagtgcactcattacaacaaacacaaagaaaaacgtttgcat

SEQ ID NO: 14562 - RNA, 173 nt, unidentified
  source 1..173: mol_type = other RNA; note = Related to JAGCXD010000191.1; note = Paludibacteraceae bacterium
gttggcagaaaaattttgactctggctcgatggtatcgtcgagtgtcattcttctaaaaaaagaattgataaatcaatgttatattttattacagtcatagactgatttatagctgtgatattcgtgttattacctatatctctttataaatacaaagaaaatatatgccatt

SEQ ID NO: 14563 - RNA, 166 nt, unidentified
  source 1..166: mol_type = other RNA; note = Related to FR900399.1; note = Prevotella sp.
aatgctacacaaattttgattctggtccgacgtgcgtcggatgtcattcttctaaaaaaagaattgataaaccaacgttttatttaattacagtcgtacgactgatttggcttaattcaaatataaagtcaatagtataaagtacacaaagaaaattaatagcatt

SEQ ID NO: 14564 - RNA, 165 nt, unidentified
  source 1..165: mol_type = other RNA; note = Related to JAFPVK010000006.1; note = Bacteroidales bacterium
gtaagcaacaaaatttgactcttgtccgatgctcttcgtcggatgtcattctcctaaaaaaagaattgacaaactcaatgttttgttttaatactgacaagtcagttatattccgtatatacttatattatggaccaacacaatacaaagaaatgagatgctttc

SEQ ID NO: 14565 - RNA, 160 nt, unidentified
  source 1..160: mol_type = other RNA; note = Paludibacteraceae bacterium; note = Related to JAFZLC010000057.1
acggaagaaacgaattttgactcttgtccgatgatatcgtcggatgtcattcttaaaaaagaattgacaaatcaatgttagatttcatctgtgatgaacttatagaattattcactacagaataaaaacgtttaaatacaaagaaaatagtaacttccgt

SEQ ID NO: 14566 - RNA, 180 nt, unidentified
  source 1..180: mol_type = other RNA; note = Related to JAAVFW010000009.1; note = Bacteroidales bacterium
gccaaacaaattttgattctcgtccgacgtgtgtcggatgtcattctttcaaaaaaagaatgataaaaacgttatattttattacagtcaaaagactgatttattattgtaaatgaatttaaaagatcaaaatctaattaattcagatagcaaaaataaaacaaagaaaagagtattggc

SEQ ID NO: 14567 - RNA, 173 nt, unidentified
  source 1..173: mol_type = other RNA; note = Related to JAAVDW010000016.1; note = Bacteroides sp.
gccaaacaaattttgacttccgtccgacgtgtgtcggatgtcattcttttaaaaaaaaagaatgtaaacccaacggtatattttattacagtcatagactgatttattatgtcttgatcttaatgatatttcataaagaagataataataaaaacaaagaaaagagaactggc

SEQ ID NO: 14568 - RNA, 175 nt, unidentified
  source 1..175: mol_type = other RNA; note = Related to JAAVCY010000011.1; note = Bacteroides sp.
gccaaacaaattttgactcccgtccgacgtgtgtcggatgtcattcttataaaaaaagaatgataacccaacggtatatttttgttacagtcatggactgatttatgcttaataacttagtgatttaaatttaaacttagccttaagacataaaaacaaagaaaaggatattgac

SEQ ID NO: 14569 - RNA, 166 nt, unidentified
  source 1..166: mol_type = other RNA; note = Bacteroidales bacterium 43_36; note = Related to MNQI01000006.1
agccaaacaaattttgactcgcgtccgacgtgtgtcggatgtcattctttcaaaaaaaagaatgataacccaagggtatattttattacagtcgtagactgatttattctttatgaatgttaatttcaaaaagacaagaatagaaacaaagaaaagagtattggct

SEQ ID NO: 14570 - RNA, 183 nt, unidentified
  source 1..183: mol_type = other RNA; note = Related to JAAVFD010000014.1; note = Barnesiella sp.
accaaacaaattttgactctagtccgacgtgtgtcggatgtcattcttttttaaagaatgataacccaacggtatatttttttacagtctttgactgatttattgatttttataataattattaaaattattgatttttctaattactttcaaaaatcttaaaacaaagaaaagagtattggc

SEQ ID NO: 14571 - RNA, 173 nt, unidentified
  source 1..173: mol_type = other RNA; note = Muribaculaceae bacterium; note = Related to JAFUKZ010000065.1
gtacaaacaaattttgacttttgtccgattgttttgtcggatgtctttcttttaaaaaaaagaaagataaccaaatggtatatttaatttacagtcgttggactgatttggtgtaatttcattttctcatgcacaacgaagaaaggaaaaatacaaagaaaaggaatttgtat

SEQ ID NO: 14572 - RNA, 165 nt, unidentified
  source 1..165: mol_type = other RNA; note = Muribaculaceae bacterium; note = Related to JAFYUK010000058.1
acacaacaaattttgatttatgtccgattgttttgtcggatatctttctttcaaaaaaaggaaggataacctaatggtatattttatttacagtccagtggactgatttgtatttctcaatcacaatgaagaaaggaataaaacacaaagaaaaggaatttgtat

SEQ ID NO: 14573 - RNA, 200 nt, unidentified
  source 1..200: mol_type = other RNA; note = unidentified bacterium; note = Related to JAAVBM010000118.1
aaccgatcaaacttttgacttttgcccgccgttgctctactactttagtgggctaagatcttccgatcgaggcgggtgttccaatttaaggcactgttccggatgtgcccaaaaaaggaataaatcaatgtcgtagattgatcttcgatcttaaaagatgattgtaacatctctataaacacaaagaaaagccatcggtt

SEQ ID NO: 14574 - RNA, 164 nt, unidentified
  source 1..164: mol_type = other RNA; note = Related to JABUTH010000081.1; note = Veillonella sp.
ctctcagccaaactttgaccctgtctgctgttactggcagatgccacatgtaaatgatggcaaataacaatgttatatcggtttttcgtaccgaattgttatattatgataatttaaaagataagttgttatctgatatcaacacaaagaaagcaagctgagag

SEQ ID NO: 14575 - RNA, 228 nt, unidentified; identical to SEQ ID NO: 14553
  source 1..228: mol_type = other RNA; note = Bacteroidales bacterium; note = Related to JAFYYM010000038.1

SEQ ID NO: 14576 - RNA, 232 nt, unidentified
  source 1..232: mol_type = other RNA; note = Related to JACXTV010000190.1; note = Campylobacterales bacterium
atccataaatattgaatgatatgctgtattcggcataagccccaaacttttaaagttactgggttaatgttttaagttaattttaaaaactaaaaactaaagaataaaatgtgtatcgtacattgggttaacgttttaacttaattttgataactaaaaacgaaagaataaatgtattcaatgcatcatgcacaatgaatatattgccatacacaatgaatagattatggat

SEQ ID NO: 14577 - RNA, 191 nt, unidentified
  source 1..191: mol_type = other RNA; note = Related to NZ_KE387264.1; note = Chryseobacterium gregarium
gtttgcacgaaattttgattttgccagttgttataaatttttatttataattatatgattggtctgttttagatgaaagtctagaactgaatgttattttaagttattcttactagatttactatttaactgtttttactatatttttctaattttaattttatctcataaacaaagaaaatattgcagac

SEQ ID NO: 14578 - RNA, 219 nt, unidentified
  source 1..219: mol_type = other RNA; note = Related to NZ_BMKD01000001.1; note = Mucilaginibacter rubeus
gctcatcaaaattttgaaatatgtctgctgttcggctatggtcgaaaaatcggcaggcagttatctgtaaggcatagcttttccgataactgaaagtgaacactgtaattttatacaggttacacttatttacctgatagtttataaattatatgctttccagccataccattatacgggtgattcggtgttgcatacacaaagaaaaagatggtgagc

SEQ ID NO: 14579 - RNA, 241 nt, unidentified
  source 1..241: mol_type = other RNA; note = Related to NZ_QMDV01000006.1; note = Pontibacter arcticus
gcctgctctaagattttgatttatgccagctgtcgcgtaggagcaatcctacgtgaaaatcggctggtaccctgtagcaatatggggtgaaagttagaatcgtcattgtatcagtctgcattgacatttactagctttttgagtccacttatcatgacttatattttatatttattatataggatttataagctgttttaagtagattgttaaatcataaacaaagaaaatacgagcaggc

SEQ ID NO: 14580 - RNA, 248 nt, unidentified
  source 1..248: mol_type = other RNA; note = Related to NZ_LVWA01000005.1; note = Pontibacter flavimaris
gcctgctctaagattttgatttttgccagctgtcatgcaggagcaatcctgtgtgaaaatcggctggtgtcccatagcaatatgggatgaaagcaacaatttggtcattgtagaccagttttgttgttaaagttgaggcccagtctgttatacattttgttatccactcttgtataccagttatgctgtttttttccccctcattctttttttcgagtttctcataaacaaagaaaacacgagcaggc

SEQ ID NO: 14581 - RNA, 239 nt, unidentified
  source 1..239: mol_type = other RNA; note = Related to NZ_LRML01000007.1; note = Rufibacter roseus
gcctgctctaagattttgatttttgccaactgtcgtggcggagaaatccaaaacgaaaatcggttggtgtcccgcagccatgcgggatgaaggtttaagtgtcatttgtctgttactagatgactgtcatttagattttattattgattatttatgatttatatgttattatgagatatgagtcgtctttaatcaacttctttgacttaaggtcataaacaaagaaaacaagagcaggc

SEQ ID NO: 14582 - RNA, 188 nt, unidentified
  source 1..188: mol_type = other RNA; note = Related to PPEG02000007.1; note = Chryseobacterium viscerum
gaccgcttaagattttgatttcgcctgctgtattcggttggcagtcccaaagtaactttggggctaaaagttagatagttatttctctttacgatttttgactattactattttttatatattttatatttaatttatgttatgatttttcttgaaatgatttcataaacaaagaaaatacagcgggc

SEQ ID NO: 14583 - RNA, 188 nt, unidentified
  source 1..188: mol_type = other RNA; note = Related to NZ_JPRO01000006.1; note = Chryseobacterium luteum
gaccgcttaagattttgatttcgcctgctgtattcggttggctgtctcaaaagtaattttggggctaaaagttagatagttatttctctttacgatttttgactattacgatttttatatattttatatttaatttatgtcatgatttttcctgaaatgatttcataaacaaagaaaatacagcgggc

SEQ ID NO: 14584 - RNA, 210 nt, Flavobacterium sp.
  source 1..210: mol_type = other RNA; note = Related to QJQY01000044.1; note = Flavobacterium collinsii
atccgcttaagattttgatttcgcctgctgtactcggttggctgtctcagaattaattttgaggctaaaagttagatagttatttttctctgtgattttaattactttggttttatctattttttcattttattttttttctattttgtctttattttatttttttatttatattttaagggtttcataaacaaagaaaacacagcggac

SEQ ID NO: 14585 - RNA, 196 nt, Flavobacterium sp.
  source 1..196: mol_type = other RNA; note = Related to NZ_VAHC01000003.1
atccgcttaagattttgatttcgcctgctgtactcggttggcagtctcagaattatttttgaggctaaaagttagatagttattttttctatgatttttaattactcttggttttatctattttttttattttgtctttattttatttttatattaatattttaagggtttcataaacaaagaaaacacagcggac

SEQ ID NO: 14586 - RNA, 217 nt, unidentified
  source 1..217: mol_type = other RNA; note = Related to MTQF01000001.1; note = Flexibacter sp.
gtccgctgaagattttgattttgccaactgtttattatgtaagtaataaaaaaccggttggatggttttcaggattaatcctgaaaactgaatgtattattggtcattcctggccatatgtgctttttatgccttcaagttattatttttaattgcttttattctattaatatatttataatttttctgggccatacacaaagaaaacaaagcggac

SEQ ID NO: 14587 - RNA, 246 nt, Flavobacterium sp.
  source 1..246: mol_type = other RNA; note = Related to NZ_OU957226.1
accgtagtgaaatattgaaatgtctatcgcaagataggcttgcctgctggaaatattatttttaatattttaaattggctggtagtttcagagtaatctggaactgaatgttagtgatgtgattttaggaacattgatacaatgttgtttcaaaaccctcaccttttttgataaattatttctttaattattttagattttaatttatgatctttggatacatagagaaagaataacaactacggt

SEQ ID NO: 14588 - RNA, 242 nt, Flavobacterium sp.
  source 1..242: mol_type = other RNA; note = Related to JABSNN010000002.1
accgtagtgaaaatattgaattgcctagtgaaaactaggcttgccaactggaaaaagtactcgtacgttttcaaatcggttggtggttgtagagcaatctataactgaatgttagtgatgtaatttttgggatagtaaaccttctctcaaaaccctcacttatatgttgattatgaattttatgttttattattttaattttaatttaatgaagatacatacataaagaatactactacggt

SEQ ID NO: 14589 - RNA, 217 nt, unidentified
  source 1..217: mol_type = other RNA; note = Related to NZ_CP060695.1; note = Polaribacter pectinis
accgtagtataaaaaattgattacctgtttaggcaggtgttctgctgtattcggcagtaggttgcagtttactgtaactaaatgttattatcgttattgtattgaagttaagtcttcttatagtaatatttttttatatttttttaagtattatttttttaattatttataattattaatttattacaattcataaagaaagaattgatgctgcggt

SEQ ID NO: 14590 - RNA, 225 nt, unidentified
  source 1..225: mol_type = other RNA; note = Related to NZ_SLUP01000001.1; note = Mariniflexile fucanivorans
accgtagttaaaaaattgaattgcctgcttcggcaggtagtctgctgtattcggcagatggttgcagtttactgcaactaaatgttagagatgttattgtaacctagttcaaaaccctcactttttttagtttttaatattttattattatttattttaatagtgaaatctactttcaaagctatttaatttttaaagtcatagagaaagaattaaagctacggt

SEQ ID NO: 14591 - RNA, 233 nt, unidentified
  source 1..233: mol_type = other RNA; note = Related to NZ_CP019333.1; note = Gilvibacter sp.
actgaagtcactgtattgacccgcctgccttcgggcaggtattctgctgtattcggcagaatgttgtagccatgctacaactgaatgttagaggagttattttgactgatttcttttaagaaaccacaaaaacaaccctcactttttattgctatgatttttattatcatggtaagtcatggcaaggctatttttagcatatggagccatagataaagagtatatacttcagt

SEQ ID NO: 14592 - RNA, 212 nt, unidentified
  source 1..212: mol_type = other RNA; note = Proposed Natronogracilivirgula saccharolytica; note = Related to NZ_JAFIDN010000022.1
gcccacacaagatattgaaactgcacgctgtattcggcgtgtctgtccggcgttaagtgttgcaacacttgccgggctgaatgtcagtacttgatttgcaggtagatcaggtaaggttatactttacatgagatacatgtgaatagggactattgactgtatactattattattaatgatagttcattcatacataaagaatatcagtgggc

SEQ ID NO: 14593 - RNA, 185 nt, unidentified
  source 1..185: mol_type = other RNA; note = Sphingobacteriales bacterium; note = Related to SEFL01001225.1
gcagatagcctgggggcttgctcccaggcgaaatgttctaaatgtaatttttttagcgcttttattatttttcgctatagaacttgaaactattgaacattattaattatttattatttatcgatattagctattgcagttattagagattgatagttttcatacacaaagaataaggggcgggc

SEQ ID NO: 14594 - RNA, 203 nt, unidentified
  source 1..203: mol_type = other RNA; note = Related to NZ_BDCW01000118.1; note = Tenacibaculum ovolyticum
acctgctgtacaatattgattttgccaactggaaattatttttttaaaatttcaatgatcggttggtgttccgaatttattcggaatgaatgttatttttgttaaatatctttttgaagttattattagaatgatctatttcttaaattattctttttaatattctttaaataattcctaaattaaagaataaaacagcaggt

SEQ ID NO: 14595 - RNA, 266 nt, unidentified
  source 1..266: mol_type = other RNA; note = Related to NZ_JHZZ01000001.1; note = Polaribacter sp.
acctgctgtaaaatattgatttttgccaactggtaattaaacttttaagttttgtttcaacgatcggttggtatctcagtaattatccgacaaccggaatttcggatactgagatgaatgttatttaaggttattgtgttagccttttagagtaacttttataaattattcttttaagatatatttttattattatttcttttaagatatatttttaaattattttttaagtaatttattcataaacaaagagtatagcagcaggt

SEQ ID NO: 14596 - RNA, 198 nt, unidentified
  source 1..198: mol_type = other RNA; note = Related to NC_015510.1; note = Haliscomenobacter hydrossis
gcctgtctaaagatattgatcgtgcatgctgtatttcggcatgtctcctggcttttagccaggtgaacgttttgaggtcattgttgaagatgattggtcatctgcttgtttattgtgatgataaataatgatggttgatttgtttttgatgatgatatggttgaattttactccatacgaaagagtatcatggcaggc

SEQ ID NO: 14597 - RNA, 212 nt, unidentified
  source 1..212: mol_type = other RNA; note = Lewinellaceae bacterium; note = Related to JACJYR010000001.1
gcctgcctgaaagatattgaacgtgcatgctgtatttcggcatgtcttcccggttcccgggatgaatgttagcgttgtcattgtcagtattgtgctttctattgtcattttcatttttatgaaatgatgatgtgattgatgatattgctgatgatgaatgagtgctgttattgcagttctcatggttcatacgaaagagtatcacggcaggc

SEQ ID NO: 14598 - RNA, 216 nt, unidentified
  source 1..216: mol_type = other RNA; note = Related to NZ_JAAORA010000001.1; note = Candidatus Chlorobium masyuteum
gcctgccgcaagatattgactagtgccagctggggttaatcgaaagatgtatccagatcggctggtgtcccgaagcaattcgggatgaaggttcccgggttattagttggatctcagattgtaatgatttttttttacgatttgatttctacctactaaaccccgtatctaatttgaattcttttcaaagtcatacacgaagaatatgcggcaggt

SEQ ID NO: 14599 - RNA, 246 nt, unidentified
  source 1..246: mol_type = other RNA; note = Saprospiraceae bacterium; note = Related to JADJUM010000002.1
gtctgatgtacaagatattgattagtgccatctggaaaaggtcgaaaggtttttcaaatcggatggtgtttcaggttcgcctgaaatgaatgtatctatataattgattcgtcgaaagttgaaatttgtcgatctaacgatagctttttaataattcgtgaattaaattattgataattatttattttgaatttatgtatatataaatgtatgtaaatatcataaacaaagagtatgacatcagac

SEQ ID NO: 14600 - RNA, 200 nt, unidentified
  source 1..200: mol_type = other RNA; note = Flavobacteriales bacterium; note = Related to JACJZT010000003.1
gcctgttgtaagatattgatttttgccaactggaaattatcgtaaggtagtatcagatcggttggtgtcttcaaggtaacttgaggatgaatgtttaaaagtaattactctagcaatttacttctggtaatgcttaacttaaaattattaacctttaatttttaatacaagttccataaacaaagagtatagcaacgggc

SEQ ID NO: 14601 - RNA, 179 nt, unidentified
  source 1..179: mol_type = other RNA; note = Related to SEAO01000392.1; note = Chryseobacterium sp.
acctgttaacaaatattgaatttgctagacggactggtggtaacgccaatcataatgagctagtggttaagacgtgtgttttaactgaatgtctatggaatattcccatcagaacaccttatactttaatcagttttatgaaattgatattgttacatatacaaagaatagagacaggc

SEQ ID NO: 14602 - RNA, 187 nt, unidentified
  source 1..187: mol_type = other RNA; note = Related to NZ_JAFVME010000001.1; note = Pedobacter sp.
gcctgctgaaatgtattgaatttgccagttggaggtttgtaacctcagatcaactggtagctggtaacttaagaagttatgcagctgaaggtttgtatcggtcattacttgacacgtttttacctgatattatgaaatccttatgatctctttatacttgcatatacaaagaataattcacgcaggc

SEQ ID NO: 14603 - RNA, 197 nt, unidentified
  source 1..197: mol_type = other RNA; note = Related to NZ_CP049834.1; note = Aquirufa sp.
gtctgccgtaacaaattgaaattcgccatttggagattgtataaatctcaaatcggatggtattctggatatttcaggatgaatgtttcttggtttttatataatatttaaaaattaagaatattattatttttattattttaatattatttgggaaaataatatttagatcatatacaaagaatttcacggcagac

SEQ ID NO: 14604 - RNA, 259 nt, unidentified
  source 1..259: mol_type = other RNA; note = Related to NZ_CP094531.1; note = Chryseobacterium sp.
gcctgttttaagattttgattttgcctgctgttggagatttttccaaaaaccggcaggtgttccgaaagtttgcactttcggaataaaggttaggtgattatttattgtcgattttcttcagttgagattttatttattatttcaatagaattttattattatatatttcaacgtgggtctacgcccaaaaactgatattagtaaaaaccctcacttattttttttataattgaatagataaagaaaacagaaacaggc

SEQ ID NO: 14605 - RNA, 263 nt, unidentified
  source 1..263: mol_type = other RNA; note = Related to CP033935.1; note = Chryseobacterium balustinum
gcctgttttaagattttgattttgcctgctgttggaagttttcccaaaaatcggcaggtgttccggagatgtaaatcttcggaataaaggtttggtgatcatttattgtagatttttcttcagttgagatttatttatttattatttcaataggaattttattattatttatttcgatggggcgctacgcacaacaactgatctcagtaaaaaccctcacttatttttttataattgaatagataaagaaaacaaaaacaggc

SEQ ID NO: 14606 - RNA, 264 nt, unidentified
  source 1..264: mol_type = other RNA; note = Related to VOXE01000004.1; note = Chryseobacterium sp.
gcctgttttttagattttgatttcgcctactgttttttgtaggtattcctggcgaagctagggatgatgaaggtttcttttataaattgatttagatttataggtcttagtagactgaggatattattttataataattggtaatattattttagtagatcattggttttactttattacatcttgaatttttgatcaatttaatttcagaagtaccctcacttattttagcaattgaatatataaagaaaacacaaaacaggc

SEQ ID NO: 14607 - RNA, 241 nt, unidentified
  source 1..241: mol_type = other RNA; note = Related to NZ_LR134503.1; note = Kaistella jeonii
gcctgtttttaagattttgatttcgcttgctgttgggtctcccaaaaatcggcaagtgttccggaaattattttccggaatgaaagtttggactttatagtaattagagagaattttgattaacaatattttaatatatattattatttatattttgttgtcaggattgccctcgctcattacgctgtcctttcttataccttatttaaagtcgaatagataaagaaaacaaaagacaggc

SEQ ID NO: 14608 - RNA, 237 nt, unidentified
  source 1..237: mol_type = other RNA; note = Related to JAFIBT010000001.1; note = Chryseobacterium sp.
gcccgtttaaattttgactacgcctactgttttttgtaggtattccaatttattggaataaattaatggattagttagcagcacatatatatacgataatatttttatattaatttaacttttactatttataaattatcttaaattttatatgaattttgttaactaacatttatatgatgattatcaattatgctttttggctatcttaaataaaataaagaaaaacaaacgggt

SEQ ID NO: 14609 - RNA, 233 nt, unidentified
  source 1..233: mol_type = other RNA; note = Related to JADJJD010000012.1; note = Saprospiraceae bacterium
acttgcctcaagatattgattcgtgggtgctgggagtaattgagaaatcaatgaaacaatgatcggcatctttatcctgatctcggttgggatgaatgtcactaagacatacgccattgtggatgttggcctaataaccaatcgtctgaacttaagatgtaattattagtgataaatagttaataagtcttccttcaactgtatcctgtatacaaaaagagtatccggcaagt

SEQ ID NO: 14610 - RNA, 231 nt, unidentified
  source 1..231: mol_type = other RNA; note = Related to QKTX01000002.1; note = Algoriphagus aquaeductus
acctgcctaaggtattgattcgtgggtgctggtcccgagtaatcgggacatgatcggcatcttttcccggcccaaagtcgggatgaatgtccctcgggcattattgaagcgttttgcctcctctcggggatgtgaagcttttggttgattctgtataaaaagttctttatgaatttattgataaagaatatacaaagattcatttccatacaaatagagtatcaggcaggt

SEQ ID NO: 14611 - RNA, 240 nt, unidentified
  source 1..240: mol_type = other RNA; note = Saprospiraceae bacterium; note = Related to JADZFD010000065.1
acttgccacaagatattgattcgtgggtgctgggagtaactggataaccagtgaaacaatgatcggcatcttctcccgacctctggtcgggatgaatgtcacttagcatttttaacatggattgttgattttaaaataaaaaatcaatagaaacaaattgttattaatataaaaagtgaacaataggtatcgaatttagctgcagctgaattatccatacaaaaagagtatccggcaggt

SEQ ID NO: 14612 - RNA, 213 nt, unidentified
  source 1..213: mol_type = other RNA; note = Bacteroidetes bacterium; note = Related to VGMK01000021.1
acttgccagaaggtattgattcgtgggtgctggtctcaaatttcggtttgagacatgatcggcatcttctcccgacctgtgttgggatgaatgtcacttaggaatttattgcagtgtgtattgatttcaatgtcaatatgaaattgttatttatgaatttattagtgattaataggtattgatttatacatacaaatagagtatcaggcaggt

SEQ ID NO: 14613 - RNA, 237 nt, Flavobacterium sp.
  source 1..237: mol_type = other RNA; note = Related to NZ_NOXV01000174.1; note = Flavobacterium cyanobacteriorum
acttgccacaagatattgattcgtgggtgctggtctcagatttcggtttgagacaatgatcggcatcttctcccaacctctggttgggatgaatgtcacttaggcatttttaacagcggttattgatttcaatatcaataatatgaagttgttattgatgtaattattagtgatgaataggtattgatttcagttgtaatgattgaaatattcatacaaaaagagtatccggcaggt

SEQ ID NO: 14614 - RNA, 230 nt, unidentified
  source 1..230: mol_type = other RNA; note = Related to QNTX01000003.1; note = Elizabethkingia miricola
acttgccacaagatattgatttgtgggtgctggttctagatttcggtttggaacattgatcggcatcttctcccgaccactggttgggatgaatgtcacttaggtatttttaacagcttattgattttaataatttattagttgttattatgtatttatttgtgatttattgatttagaatttcagttatttttattgaaatattcatacaaaaagaatatttggcaggt

SEQ ID NO: 14615 - RNA, 308 nt, unidentified
  source 1..308: mol_type = other RNA; note = Related to JAGPCT010000008.1; note = Saprospiraceae bacterium
acttgccacaagatattgattcgtgggtgctggaagtaactggttaaccagtgaaacaatgatcggcatcttctccctacctatggtagggatgaatgtcacttaggcatttctaacagcggaaacaataatcggcatcttctcccaaactgtggtagggatgaatgtcgcttaggcatttctaacaacggttattgataagaagaacaataatattaagttgtaattgatgtaattcttagtgatgaatatcgattgaatttcagttcatgtaattgaaatacatacaaaaagagtatcaggcaagt

SEQ ID NO: 14616 - RNA, 229 nt, unidentified
  source 1..229: mol_type = other RNA; note = Related to JAAZMS010000454.1; note = Bacteroidales bacterium
acttgccacaagatattgattcgtgggtgctggttccgaattatcggaacaatgatcggcatcttctctcaacctttggttgggatgaatgtcactagagtcatttttaacagtgcttaactattgattctctgcagaactgttatttatgaattattctttattctgctgaattaacttagcttaagctgaggctgaattattcataccaatagagtatccggcaggt

SEQ ID NO: 14617 - RNA, 241 nt, unidentified
  source 1..241: mol_type = other RNA; note = Related to NZQO01000147.1; note = Flavobacteriaceae bacterium
acctgtcctaagatattgaaacgtgggtgctggctctagatattgttctaaggcaatgatcggcatcttctcccgaccactagtcgggatgaaggtcacttaggcattttgatcagctctgttattaatctcagtatttataatatgaagttgtcattgatgtatttataagtgatgaataggtattgcacttcagttgaaatgattgaaatgttcatacaaatagagtatccgggcgggt

SEQ ID NO: 14618 - RNA, 232 nt, unidentified
  source 1..232: mol_type = other RNA; note = Related to BMWX01000006.1; note = Echinicola pacifica
acctgccgtaaggtattgattcgtgggtgctgtcccggttttctgggaaacgatcggcatccttttccttccaaaagggccggccagcccggagggaatgaaggttatattggtaaaacacagattcatcatccagcttttgctgaactcttgggtttctgtttttttattatgttatgtatggatttaggtaatcaacattacttcaatacacatagaatatctggcaggt

SEQ ID NO: 14619 - RNA, 231 nt, unidentified
  source 1..231: mol_type = other RNA; note = Related to NZ_CP080025.1; note = Echinicola sp.
acctgcctaaaggtattgattcgtgggtgctgtcccggtttcccgggaaaagatcggcacctctttcccttcatatgggccggccagcccggagggattgaatgttattttggtaaactccaatcgacttcccttgtgttgttcttcctttggatatcgattattgtttatgatgatatatggattgatgaaatatacacacattcattacaaatagaatatccggcaggt

SEQ ID NO: 14620 - RNA, 268 nt, unidentified
  source 1..268: mol_type = other RNA; note = Related to NZ_JACYTQ010000004.1; note = Echinicola sp.
acctgtccgaagatattgattcgtggatgctggcttattcatttaagtatggatcgagcaatgatcggcatcttttccctaccatttgggttggccagcccggtagggaagaatgtttctacttgaataattaatggttttcatctttagttatattagctattgaacttgactgttattatttatgatattgatgtattttctggagtttaagctaatttattttagcacagaatcatcatccttacaaaaagagtatccgacaggt

SEQ ID NO: 14621 - RNA, 237 nt, unidentified
  source 1..237: mol_type = other RNA; note = Related to JADYZM010000024.1; note = Flavobacteriales bacterium
acttgccacaagatattgattcgtgggtgctggaagtagttgggaaaccaatgaaacaatgatcggcatcttctcccgacctctggttgggatgaatgtcactgagacatttttaccagctactattgatttcaacgtcaataatataatgttgttattaatgtaattattagtgaagaataggtattgaatttagctatagctgaaacattcatacaaaaagagtatcaggcaagt

SEQ ID NO: 14622 - RNA, 236 nt, unidentified
  source 1..236: mol_type = other RNA; note = Related to NZ_CP041345.1; note = Tenuifilum thalassicum
acttgcctaaagatattgatttgtgggtgctggcctaaatttgtttaggcaatgatcggcatcttattccaacttttgttggaatgaatgtcagagtggcattaatgagcacagtttctgagcataacttcagaactgagatttacattgacgccagtaataacgctgactaagaataacccctaattaaattttttttttttggtctttaatacttatagagtatcagggcaggt

SEQ ID NO: 14623 - RNA, 247 nt, unidentified
  source 1..247: mol_type = other RNA; note = Related to QMPL01000018.1; note = Bacteroidetes bacterium
acctgccaaaagatattgactcgtgcatgtcggttttgttgcttgcaacaaaacaatgatcgccatgttttcccgaccttttggtcgggatgaatgtctctgatgaattaatagctggttgtcatattatatctgaaatgatatgatgcaatgaaactgttattgatgaatttattagtgatgaataggattacggatttcagttaataaagctggaatattcatacataaagagtatcgtgtaggt

SEQ ID NO: 14624 - RNA, 242 nt, unidentified
  source 1..242: mol_type = other RNA; note = Related to JAGPFM010000063.1; note = Bacteroidales bacterium
acttgcctaaagatattgactcgtgcatgctggttttgttggcgacaacgaatcaatgattggcatgttctcccgacctctggttgggatgaatgtccctgacgaatttataacggctaatgtcttgtaatagaggtttattataagatatgaagttgttattgatgaatttttcagtgatgatagaaatcgaattcaattgaaatgttgaattgttcatacataaagagtatcaggcaggt

SEQ ID NO: 14625 - RNA, 208 nt, unidentified
  source 1..208: mol_type = other RNA; note = Related to NZ_WOFO01000011.1; note = Cyclobacterium sp.
acctgccaaaaggtattgattcgttggtgctgttccgggtaactggaaactgatcggcaccttttcccagaaagttctgggatgaacgttccttaggaatgatcaagctccttaataggatttaaacttttctggttttgaagacgatgatatgtttgataaataaaaataccacagattcttcataccaatagaatatccggcaggt

SEQ ID NO: 14626 - RNA, 217 nt, unidentified
  source 1..217: mol_type = other RNA; note = Related to AMZY02000008.1; note = Mariniradius saccharolyticus
acctgccaaaggtattgatctgtgggtgctgtttcggtttatcgaaaagatcggcacctgttcccgacatttgttgggataaatgtctcttgggaattttccaactcctgagtagacttctgacctccatttggtcctttgatagtttagtctttatagatattttatgtatttataattacacaaattcatcatacgcatagaatatcaggcaggt

SEQ ID NO: 14627 - RNA, 220 nt, unidentified
  source 1..220: mol_type = other RNA; note = Crocinitomicaceae bacterium; note = Related to JADJXZ010000008.1
acctgtcctatgatattgatcgtgggtgctggtctcagatttcggtttgagacaatgatcggcatcctgtcctgcaaatctaggatgaatgtaatgaagcattgtgtcatcaatggcgttcggtaacgggtcatcaacccatccgaaatgttttattatttattaatttatagattttggtgatattattatcaacacacaaaaagagtatcggacaggt

SEQ ID NO: 14628 - RNA, 219 nt, unidentified
  source 1..219: mol_type = other RNA; note = Bacteroidia bacterium; note = Related to JAJTAY010000029.1
acctgccacaagatattgacccgtggatgccgggagtaggtccgctggcccggactgaaacaatgatcggcatctcttcccggatgttttccgggatgaatgtccatgaggcattgtagtcagttgctattgattgaataatcataatagcaattgatatcatgataaatgaattagtaatcattatcatgatacatacataaagagtatcaggcaggt

SEQ ID NO: 14629 - RNA, 252 nt, unidentified
  source 1..252: mol_type = other RNA; note = Bacteroidales bacterium; note = Related to DOXR01000029.1
acctgcctaagatattgattccggatgctgggagtaattgggaaaccaatgaaacaatgatcggcatctcttcccgcccttgaggtccttgtggcacttgtggctgggataaatgtccattggacatgtctggagcctgcatagcatttatagcaatgaatgaaattcaagatatgaagctatgtaagctagatatgattgagatcttgtgagatcaagcacgagctcatacataaagagtatcaggcaggt

SEQ ID NO: 14630 - RNA, 202 nt, unidentified
  source 1..202: mol_type = other RNA; note = Weeksellaceae bacterium TAE3-ERU29; note = Related to JAHUUM010000008.1
acctgtcaaaagatattgatttcggatgttggtttcaattttaaaattgaaacagatcggcatcttctctactcggtagaggctgaatgttaggaggtaaattcaatatagatttaagatatatttttatattttaatcctatctaatttacccccactaatttatttcaagttaatttatacaaaaagaatatcgataggt

SEQ ID NO: 14631 - RNA, 262 nt, unidentified
  source 1..262: mol_type = other RNA; note = Related to NZ_AJYA01000040.1; note = Nitritalea halalkaliphila
acctgccataagatattgattcgcgggtgctggccctgctctggcagggcaatgatcggcatctattcccaatcgcgtattgggatgcatgtgtggagagcattctcaatttaaatgaaacagtatatatgtatactattcatttaaaatgcgccattaacattctaatttaccccgctactggggaaatagacctttgacagtgtcgatacacaggtatcggggtcatcggtcctacatacaaatagagtatccggcaggt

SEQ ID NO: 14632 - RNA, 214 nt, unidentified
  source 1..214: mol_type = other RNA; note = Related to NZ_CAKLPZ010000001.1; note = Lewinella maritima
gctcgcccagaagatattgactcgtgggtgctggttctagctacggctcggaacaacgatcggcacctcttccctgatttcggtccgggatgaacggttttcagttgaggatctagatagatgcagatgaatgaacgtataacgcttatttatttatgcatataggtgtacgctttaggattagagtgtggcacaaatagagtatcgggcgagt

SEQ ID NO: 14633 - RNA, 196 nt, unidentified
  source 1..196: mol_type = other RNA; note = Related to NZ_JAATJH010000004.1; note = Lewinella antarctica
gcctcaagatattgattcgtggatgctggcactggttccgaccggtgcaatgatcggcatctcttccgggctactagtccggtcgaatggcccagagagatttgggctcttttgaggatcttaatcaataaatgattatggtttttatgaatttatgaggatttaaagcttcatacaaatagagtatcggacgggt

SEQ ID NO: 14634 - RNA, 247 nt, unidentified
  source 1..247: mol_type = other RNA; note = Related to PXTU01000456.1; note = Bacteroidetes bacterium SW_10_40_5
acctgcctaagctattgattcgtgcgtgctggttcgctttttggcggacaatgatcggcacgtgagtccggctttatgccgggctgaatgtcaaaagggcattttgtcggctactgccttgattaaatctccttattcttcttggaaagggatgttatgaataaggcttagcaatgctttaattgatatatttatttataaattatataaacatacttttccatacggagagaatacaaaggcaggt

SEQ ID NO: 14635 - RNA, 258 nt, unidentified
  source 1..258: mol_type = other RNA; note = Related to NZ_FNQK01000004.1; note = Bizionia paragorgiae
acctaaacaaaagtattgatcgcgtatgctggtttaattagtagtaattaaacaacgatcggcatatattctaatcgtttattcgattggaataagaatgttatttttaattagtccacaatgtttaaaacacataattggttctaattatttatagcatttattatattttttatattattattatatattatttcaatgtaatattaataagatatgtaaagtttaaaatcatacaaaaagaatagacgtttaggt

SEQ ID NO: 14636 - RNA, 273 nt, unidentified
  source 1..273: mol_type = other RNA; note = Related to NZ_CP039451.1; note = Psychroserpens sp.
acctaaacaaaagtattgatcgcgtatgctggtttaattagtaataattaaacaacgatcggcatatattctaatcgtgtattcgattagaataagaatgttaattattaattagtccacaatgtttaaaacacaaaaaatggtttaatttttaaatagatagcattatattatttatatattatttagttctattattattattattattattattatttagatctatttatattaagtttaaaatcatacaaaaagaatagacgtttaggt

SEQ ID NO: 14637 - RNA, 257 nt, unidentified
  source 1..257: mol_type = other RNA; note = Related to FTMA01000004.1; note = Maribacter ulvicola
cccaaactgaaattattgaaagcatatgctggcctgatgattaattcaaaggcaataatcggcatataatcctatagaaatataggatgaatgttatttgttaattgtaaatagacatggcaaataaagaaaagacttttatgtttttgataacattgtcattatttcatttacagttcatataatttatttttttttaaaggcttgaatgctactaaggttttcaatcgtcatacaaaatgaataaaaggtttggg

SEQ ID NO: 14638 - RNA, 251 nt, unidentified
  source 1..251: mol_type = other RNA; note = Related to NZ_CP042476.1; note = Antarcticibacterium arcticum
acctgcccgaaagatattgactttgggtgctggtcctgaaattatcaggacaatgattggcacctgtacccgactttatgtcggcaaaatgttagcggatgatttagacctcgtttcaaaacatccactgataattttattatgattttattatttttaattaagatctgttttattattaagacaaaagttaaagttattaatgacttagtttttgaattataacatacataaagagtatcggggcaggt

SEQ ID NO: 14639 - RNA, 238 nt, unidentified
  source 1..238: mol_type = other RNA; note = Related to JAJSON010000015.1; note = Gramella sp.
acctgcccacagagatattgaatttgggtgctggtcctgaaattatcaggacaatgatcggcatctttacccgacttttagtcggccaaaggttagtgaggaattgaatcctaaatttcaaaacctccacttattatttttttatgatttattattataaactatttcaagacaaatgaattagttctgattattgaaattgctttataatatatacttaaagagtatccgggcaggt

SEQ ID NO: 14640 - RNA, 199 nt, unidentified
  source 1..199: mol_type = other RNA; note = Microscillaceae bacterium; note = Related to DMXI01000354.1
acctgtctaaaatattgatttggtgctgtcttgatcctatcaagaagatcggcatcggtttccagtctctcacgggattgggaaaggtttatttagacatcataagtttatttcaaaaatggctcgaaaaaccttaataataaataaataattaataacaatttattacggttacatacataaggaatacaagacaggt

SEQ ID NO: 14641 - RNA, 244 nt, unidentified
  source 1..244: mol_type = other RNA; note = Related to NZ_RJUG01000002.1; note = Kaistella daneshvariae
atctgcattattgaattttgattgctgggagtaactgcaaagtgaaacaatgatcggcaatcggctctttattccgtaaggtgtagggagcataatgttagttgacaattttttgcagttaacatatttggcaatttagctgaatggctattatctttttatcttttattatctttttaacattaggtacattggcatttagacatttcggttaacgattcatacataaagaatacatgcagat

SEQ ID NO: 14642 - RNA, 239 nt, unidentified
  source 1..239: mol_type = other RNA; note = unidentified bacterium; note = Related to JAAFAH010000017.1
aactgccgaaaggtattgaattatggatgctaccccatatggggtttaaagattggcatctttgtccggtttaccggactgaatgtttctataaaattatgtttaggatttctaactaattttaaagaatctattattaaatgaatatttattttaattgaatatttattgaaaaaacttaacatttcttttgaaataatttaagttaatatattcatacacaaagagtactggcagtt

SEQ ID NO: 14643 - RNA, 246 nt, unidentified
  source 1..246: mol_type = other RNA; note = Related to ALNN01000005.1; note = Capnocytophaga sp.
acctgtgagtatattgatttctttgattgctggaagtttgagttatccctttttggatgatttaagtttcaggtcggcaattggcttaggattttcctaagtataaggttaccaatggatcaagataaatatagctatattatattgatattgatttatattgatattgaaaatatcatttttcttgatttcataagaaccttctctggtatattatattcatacaagtagaatagaaatacaggt

SEQ ID NO: 14644 - RNA, 210 nt, unidentified
  source 1..210: mol_type = other RNA; note = Related to JAACZX010000460.1; note = Chitinophagaceae bacterium
accggttaaatgttttgacttcgcagggcgtatcgccctgtagctttttccagtaacggaaaaaggaaaagttctttatagtcgaattgtgctgttgagaactattttggcctattaacccccgttaatttttgttttaattgggaataatagatatgtatttgatgtttttatgtctgttggacctggacatcatagaaaacaaccggt

SEQ ID NO: 14645 - RNA, 201 nt, unidentified
  source 1..201: mol_type = other RNA; note = Related to JAFDXN010000025.1; note = Bacteroidetes bacterium
gcctgctaacgaaattgattttcgcctgttggccttcgggcagatcgacaggctgtctgtttcctgcaaaggaggcagatgaatgtatctgtagtcattagtagcaatactgcttttaagatttaagatataattgatatttttattattgataatagtcttagttggctatgttcatgtagaaagagttttacggcaggc

SEQ ID NO: 14646 - RNA, 236 nt, unidentified
  source 1..236: mol_type = other RNA; note = Lewinellaceae bacterium; note = Related to JACJYQ010000002.1
gcccgcttgaagatattgaatcgtgcatgctggacttatccatttaggaataagtcagatcggcatgctactctgtatcgggtttccggtacggaggtaatgttctttggtcattgattagtattgaaattcattgtatgttatttattaatataataattaatttataatatataataagaattcattattaatagatgcctttaattttcatacaaaaggaatattgtgcgggt

SEQ ID NO: 14647 - RNA, 225 nt, unidentified
  source 1..225: mol_type = other RNA; note = Related to JAGOPY010000019.1; note = Bacteroidales bacterium
gcctgcccataatattgaacgtgcgcgaccgtttcggagcgttttcccgactttgtcgggatgaatgtcataacatgatttgtcgttgtgaaacgattaattaattgacgttttgtattgtgaataatagaaaggtgaatagaaatgtgaagattattttttttctcattttttaataattcataccctctcttaatttcattcataaagaatagaccggcaggc

SEQ ID NO: 14648 - RNA, 222 nt, unidentified
  source 1..222: mol_type = other RNA; note = Bacteroidales bacterium; note = Related to JAFGOZ010000659.1
gcctgctcagagatattgaacgcgcatgctggtcccgccctcgggcgggacagatcggcatgtttccctgacttcggtcggggtgaatggtttctggttatagaaattgactgcggaagcatcacaagctgacgcttaaactcattcgtaacttcaaaccataaacacttaagccattagcatcgctaatgctaatacatacataaagaatattgagcaggc

SEQ ID NO: 14649 - RNA, 194 nt, unidentified
  source 1..194: mol_type = other RNA; note = Related to JACMPG010000245.1; note = Spirosoma sp.
gcctgttccgacaggtattgattttctgcacgtgcgtttcgccgtgtggccccggcgcaagctgcgggctgactgtaattgggtaattgatactgattatgattattgaacatgatcttagttattattaattatttaaattattagtagtaaaaagaagattgtgcatacataaagagtaccggcctactggc

SEQ ID NO: 14650 - RNA, 194 nt, unidentified
  source 1..194: mol_type = other RNA; note = Related to NZ_JACXAA010000017.1; note = Spirosoma sp.
gcctgtcctaaggtattgattgtgtgcacgtgcgtttcgctgtgtagtctggtgtaagccggactgaatgtagttgggtaattggtggtgttgatggttgaagtgaatgctctttaactgttggcctggactgtattactttaattatattattaattattgtatgcttattcatacataaagagtaccgaggc

SEQ ID NO: 14651 - RNA, 193 nt, unidentified
  source 1..193: mol_type = other RNA; note = Related to NZ_QGGO01000004.1; note = Arcicella aurantiaca
agacacccacaaggtattgatttttgcaaagcgtttcgctttgtggtttaggcattgttctaaacgtaatgttatgtgttaacatcgttgcaagacatttgtgacgtatttagacatattactattatatatattatttatttaataatgtgggaagtaggttcaattcatacaaaagaatacgtgggtgtct

SEQ ID NO: 14652 - RNA, 217 nt, unidentified
  source 1..217: mol_type = other RNA; note = Saprospiraceae bacterium; note = Related to JADJRO010000003.1
gccaacaaaaagattttgaactgttcattgcgatttgcaatgtcggccagcaatggctgtttaaatggtagttattttaattgttcagcattgagctataatgaacatttagttattgaatatatcagtaattaatatattataataaaatatgaataaatgaatattgccatcattgaatttatgatggattcatccataaagaaaatcagttggc

SEQ ID NO: 14653 - RNA, 197 nt, unidentified
  source 1..197: mol_type = other RNA; note = Related to NZ_JNLX01000031.1; note = Hymenobacter sp.
atctgcgttagggcttttgaccccgtgcggcgttgcgccgcgcccgtttaaacaacggcagtaatgacagtaaacgaaattgattaaaatgatttaattgattttttgtcattattatctttttgaatagttgatgatttttatcaattatttatttcttatacaataagtataggatatgaaaattcccagcagat

SEQ ID NO: 14654 - RNA, 201 nt, unidentified
  source 1..201: mol_type = other RNA; note = Related to NZ_SRLD01000019.1; note = Hymenobacter elongatus
acctgtgactggggttttgaccttgtgcggcgttgcgccgcgcccgttctgacaacggcatcattgacagttgactcgattgattaatttgatttaattaattgatttgattgactctgaattgagttttaattcagaatttattttttgaattattatctgcttcttaagtagaagacgcaaagaaaactcccggcaggc

SEQ ID NO: 14655 - RNA, 199 nt, unidentified
  source 1..199: mol_type = other RNA; note = Related to NZ_QYCN01000007.1; note = Hymenobacter rubripertinctus
acctgtgactggggttttgaccttgtgcggcgttgcgccgcgcccgttttgataacggtatcattgacagttgacttgattaatttttatttaattaattgattttattgtctttgaattgagtctttattcagaatttattttgaattatcatctgctttccttgaagtagaagacgcaaagaagactcccgacaggt

SEQ ID NO: 14656 - RNA, 219 nt, unidentified
  source 1..219: mol_type = other RNA; note = Related to JADKEM010000006.1; note = Bacteroidetes bacterium
acctgcggaaaggattttatttgtgttgcgtttcgcaacatgctccacaatgtgatttcattgtagattataattgtaatgattatgatgttagcgatgtagctgtaattgtgattattgtattaattgtttttaattgtttagttattattaattaatcattgatagagattattaatgtaattagatatagaaattaagaaaagaaatcccgcaggt

SEQ ID NO: 14657 - RNA, 128 nt, unidentified
  source 1..128: mol_type = other RNA; note = Related to NZ_WBWZ01000001.1; note = Brucella anthropi
aaaattacgaggtctcccctcgcatacgcgctgtagtaactgcggcgtaagaagaaatacaagtacaatatcgtacgctccatgtcgacaatctatgcttgacatgattggagggagacctcgtgcca

SEQ ID NO: 14658 - RNA, 128 nt, unidentified
  source 1..128: mol_type = other RNA; note = Related to NZ_LT599047.1; note = Brucella sp.
attggcacgaggtctcccctcgcatacgcgctgtagtaactgcggcgtaagaacgaatgaatttacaatatcgtgcgcgccactcggactttgtggacctggcgtgattggagggagacctcgtgcca

SEQ ID NO: 14659 - RNA, 75 nt, unidentified
  source 1..75: mol_type = other RNA; note = Related to NZ_JACIEE010000022.1; note = Rhizobium azooxidifex
cgagatacgaggtctcccctcgcatacgcgctgtcgtaactgcggcgtaagagcgagaggcggaactccgcaaaa

SEQ ID NO: 14660 - RNA, 129 nt, unidentified
  source 1..129: mol_type = other RNA; note = Related to NZ_CP083370.1; note = Ensifer sp.
ttcggcacgaggtctcccctcgcatacgcgctgtaggaactgcggcgtaagagcgaatgtatctacaatatcgtgcgcgccacgtatgcctgaatgcacatggcgtgattggagggagacctcgtgcca

SEQ ID NO: 14661 - RNA, 127 nt, unidentified
  source 1..127: mol_type = other RNA; note = Related to MEDN01000012.1; note = Agrobacterium sp.
cagattacgaggtctcccctcgcatacgcgctgtagtaactgcggcgtaagagctaacgtattcacaatgacgtgcgcgccgtgcacctatatgcacctggcgtgattggagggagacctcgtgcca

SEQ ID NO: 14662 - RNA, 131 nt, unidentified
  source 1..131: mol_type = other RNA; note = Related to SGOC01000001.1; note = Agrobacterium rhizogenes
ttgagcacgaggtctcccctcgcatacgcgctgtcgtaactgcagcgtaagagctcaagtcctaaacaagatcgttgcgcgccacactatgctctgtgcacctggcgtgattggagggagacctcgtgcca

SEQ ID NO: 14663 - RNA, 131 nt, unidentified
  source 1..131: mol_type = other RNA; note = Related to WIEG01000017.1; note = Rhizobium leguminosarum
tcgcacacgaggtctcccctcgcatacgcgctgtcgtaactgcggcgtaagagctcaagtcctaaacaagatcgttgcgcgccacactatgctctgtgcatctggcgtgattggagggagacctcgtgcct

SEQ ID NO: 14664 - RNA, 127 nt, unidentified
  source 1..127: mol_type = other RNA; note = Related to SIJW01000001.1; note = Rhizobium leguminosarum
tacagcacgaggtctcccctcgcatacgcgctgtcgtaactgcggcgtaagagcaaacgtacctacaatatcgtgcgcgccacttaatgcttcgagcatggcgtgattggagggagacctcgtgcta

SEQ ID NO: 14665 - RNA, 132 nt, unidentified
  source 1..132: mol_type = other RNA; note = Proteobacteria bacterium; note = Related to JAIUOD010000004.1
aagatttcgaggtctcccctcgcatacgcgctgttgtaactgcggcgtaagagtaaatgtcatttcaaggatcgtgttgcgccactgatcttcggattatcttggcgtgattggaagggagacctcgtgctg

SEQ ID NO: 14666 - RNA, 131 nt, unidentified
  source 1..131: mol_type = other RNA; note = Related to WBWG01000001.1; note = Brucella intermedia
gcgcctacgaggtctcccctcgcatacgcgctgtagtaactgcggcgtaagagctaacgtcgaatatagaatcgttacgccccatgatgtaatgacgcaacgggggtgattggaagggggacctcgtgcac

SEQ ID NO: 14667 - RNA, 131 nt, unidentified
  source 1..131: mol_type = other RNA; note = Related to VKHP01000048.1; note = Bradyrhizobium sp.
gaatttacgaggtctcccctcgcatacgcgctgtcgtaactgcggcgtaagagcgaaagtctcatcaaggatcttgcgcgccacgttgctcgctgaatgcctggcgtgattggaagggagacctcgtgccc

SEQ ID NO: 14668 - RNA, 131 nt, unidentified
  source 1..131: mol_type = other RNA; note = Related to NZ_LUFV01000044.1; note = Ensifer sp.
atgtccacgaggtctcccctcgcatacgcgctgtcgaaactgcggcgtaagagtaaacggcaactacaatatcgttcgcgcgcccaaaaccttatgaagcggggcgtgattggaagggagacctcgtgaca

SEQ ID NO: 14669 - RNA, 131 nt, unidentified
  source 1..131: mol_type = other RNA; note = Related to NZ_FOWZ01000002.1; note = Qipengyuania nanhaisediminis
gtccgaacgaggtctcccctcgcatacgcgctgtagcaactgcggcgtaagagcaaatgtctagacatgtcgtgcgcgccatgacgattgatgattaaccgtggcgtgattggaagggagacctcgtgact

SEQ ID NO: 14670 - RNA, 132 nt, unidentified
  source 1..132: mol_type = other RNA; note = Related to SLXW01000017.1; note = Sphingomonas sp.
agctggacgaggtctcccctcgcatacgcgctgtagtaactgcggcgtaagagcaaatgtctagatatgtcgtgcgcgccatgacgattgattgattgaccgtggcgtgattggaagggagacctcgtgccc

SEQ ID NO: 14671 - RNA, 131 nt, unidentified
  source 1..131: mol_type = other RNA; note = Related to NZ_CP039250.1; note = Sphingopyxis sp.
cggagaacggggtctcccttcgcatacgcgctgtagtaactgcggcgtaagagtaaaagtctagatatgtcgtgcgcgccatgaatatcgattgataaccgtggcgtgattggaagggagacctcgtgccg

SEQ ID NO: 14672 - RNA, 128 nt, unidentified
  source 1..128: mol_type = other RNA; note = Related to MIAM01000006.1; note = Sphingopyxis sp.
aggcgcacggggtctcccctcgcatacgcgctgtcgtaactgcggcgtgagagtcaatgtctagaagaaatcgtacgcgccgccgtatcacggagccatggcgtgattggaagggagactccgtgcca

SEQ ID NO: 14673 - RNA, 129 nt, unidentified
  source 1..129: mol_type = other RNA; note = Related to NZ_LHZT01000034.1; note = Acetobacter tropicalis
cgttagacggggttctcccctcgcatacgcgctgtagtaactgcggcgtaagagtaaacgtctgtgcatatcgtgatcgcccggatcatctgtttgacttggcgtgattggaagggagaccccgtgcca

SEQ ID NO: 14674 - RNA, 130 nt, unidentified
  source 1..130: mol_type = other RNA; note = Related to NZ_JH992904.1; note = Sphingobium yanoikuyae
tctcttacggggttctcccctcgcatacgcgctgtagtaactgcggcgtaagagtaaatgtctgcacatatcatgcccgccatgatcattcggtaattcctggcgtgactggaagggagaccccgtgcca

SEQ ID NO: 14675 - RNA, 128 nt, unidentified
  source 1..128: mol_type = other RNA; note = Related to JAAVJH010000001.1; note = Sphingomonas corticis
cattctacggggtctccccctcgcatacgcgctgtagaaactgcggcgtaagagtcaaagtctgcacctatcgtgcccgccgaatgcccttgggtgcaccggcgtgattggaaggggaccccgtgcca

SEQ ID NO: 14676 - RNA, 129 nt, unidentified
  source 1..129: mol_type = other RNA; note = Related to NZ_JACYUG010000002.1; note = Sphingomonas sp.
aaaatcacggggtctcccctcgcatacgcgctgtagcaactgcggcgtaagagtaaaagtcagcacacatcgtgcgcgccgtatgctccttgtgggccctggcgtgattggaagggagaccccgtgcta

SEQ ID NO: 14677 - RNA, 130 nt, unidentified
  source 1..130: mol_type = other RNA; note = Related to NZ_NSBT01000026.1; note = Actibacterium ureilyticum
gctctcacgaggtttcccctcgcaaacgcgctgtcgtaactgcggcgtaagagcaaatgtctgcacaagaatcgtgcgccccacatgagcttcgtgcacatggggtgattggagggggagcctcgtgcct

SEQ ID NO: 14678 - RNA, 130 nt, unidentified
  source 1..130: mol_type = other RNA; note = Related to QFVT01000013.1; note = Litorivita pollutaquae
tgatgtacgaggtttcccctcgcaaacgcgctgtcgtaactgcggcgtaagagcaaaagtctgcacaagaaacgtgcgcccaacatgagctatgtgcacatggggcgattggaggggaaacctcgtgcca

SEQ ID NO: 14679 - RNA, 129 nt, unidentified
  source 1..129: mol_type = other RNA; note = Related to CH959310.1; note = Sulfitobacter sp.
tgacctacgaggtttcccctcgcaaacgcgctgtcgtaactgcggcgtaagagcaaaagtctgcacaagaaacgtgcgcccaacatgagctatgtgcacatggggtgattggaggggaacctcgtgcca

SEQ ID NO: 14680 - RNA, 129 nt, unidentified
  source 1..129: mol_type = other RNA; note = Related to NZ_JAKFZM010000082.1; note = Leisingera sp.
agaggcacgaggtttcccctcgcaaacgcgctgtcgtaactgcggcgtaagagcaaatgtctgcacaagaaacgtgcgcccccagttgaccttgagccatggggtgattggaggggggacctcgtgcac

SEQ ID NO: 14681 - RNA, 129 nt, unidentified
  source 1..129: mol_type = other RNA; note = Related to JACZKS010000020.1; note = Rhodospirillales bacterium
cgcgccgcgaggtcttccttcgcatacgcgctgtagcaactgcggcgtaagagctaatgtctgcacaaatcgtgcatgccggaggatgtgcgtcaatcctggcgtgattggaaggaaggcctcgtgtcc

SEQ ID NO: 14682 - RNA, 127 nt, unidentified
  source 1..127: mol_type = other RNA; note = Alphaproteobacteria bacterium; note = Related to JADGCC010000015.1
tgtgctgcgaggtcttccttcgcatacgcgctgttgtaactgcggcgtaagagctaatgtctgcacatatcgcgggtcgcgcgcatgattcttagcgacgcgtgattggaaggaaggcctcgtgaca

SEQ ID NO: 14683 - RNA, 130 nt, unidentified
  source 1..130: mol_type = other RNA; note = Hyphomicrobiales bacterium; note = Related to WHTM01000007.1
gatgttgcgaggcctccccttcgcatacgcgctgtcgtaactgcggcgtaagagctaatgtctgcagatatcttgcgcgccctatgacctatgtgacccgggcgtgattggaaggggaggtctcgtgccg

SEQ ID NO: 14684 - RNA, 126 nt, unidentified
  source 1..126: mol_type = other RNA; note = Beijerinckiaceae bacterium; note = Related to JAIEST010000134.1
gagccggcgagatctcccttcgcatacgcgctgtagcaactgcggcgtaagagctaatgtctggataaatcgtggcgcgccgctctattgggcgccggcgatgattggaggggagatctcgtgcct

SEQ ID NO: 14685 - RNA, 131 nt, unidentified
  source 1..131: mol_type = other RNA; note = Related to NZ_NRRL01000154.1; note = Rhodovibrio sodomensis
tcaccagcggggtttcccttcgcatacgcgctgtcgtaaccgcggcgtaagatgaaacgtctgcacatatcgtgcacgctggccaatggtctttgtggctccggcgtgattggaagggaaaccccgtgcca

SEQ ID NO: 14686 - RNA, 130 nt, unidentified
  source 1..130: mol_type = other RNA; note = Related to NZ_LMUJ01000012.1; note = Acidisphaera sp.
gattgcgcgaggtctcccttcgcatacgcgctgtcgtaacctgcggcgtaagagctaatgtcagcacagatcgggcgcgccatacgatgattgatgcgcgcggcgtgactggaaaggagacctcgtgccg

SEQ ID NO: 14687 - RNA, 126 nt, unidentified
  source 1..126: mol_type = other RNA; note = Related to SUEQ01000018.1; note = Mesorhizobium sp.
gggtcaacggggtctcccttcgcatacgggctgtgcaactgcggcctaagagctcatgtctggacatatcgagcgcgccgttcgacccggagcaactggcgtgattggaagggagacctcgtgcca

SEQ ID NO: 14688 - RNA, 126 nt, unidentified
  source 1..126: mol_type = other RNA; note = Related to REES01000140.1; note = Rhodospirillales bacterium
gtcgcaacggggtctcccttcgcatacgggctgtgcaactgcggcctaagagcgaacgtctggacacatcgagcgcgccgttcgacactgggtggctggcgtgattggaagggagaccccgtgcca

SEQ ID NO: 14689 - RNA, 126 nt, unidentified
  source 1..126: mol_type = other RNA; note = Related to RCVT01000005.1; note = Sphingomonas sp.
attttgacggggtctcccttcgcatacgggctgtgaaactgcggcctaagagcgaatgtctagacgcatcgtgcccgccgagcgacactgggcgactggcgtgattggaagggagatcccgtgctt

SEQ ID NO: 14690 - RNA, 123 nt, unidentified
  source 1..123: mol_type = other RNA; note = Related to NZ_SSTI01000022.1; note = Sphingomonas olei
tccctagcgaggtctcccttcgcatacgggctgtgcaactgcggcctaagagcgaatgtctgcacacatcattgcgcgccattcgatggaccgtggcgtgattggaagggagacctcgtgtcg

SEQ ID NO: 14691 - RNA, 126 nt, unidentified
  source 1..126: mol_type = other RNA; note = Related to JAGMXV010000066.1; note = Rhizorhabdus sp.
cgtccaacggggtctcccttcgcatacgggctgtgcaactgcggcctaagagcgaaagtctagacacatcgagcgcgctgcccgttaatgggcgactggcgtgattggaagggagacctcgtgtcg

SEQ ID NO: 14692 - RNA, 126 nt, unidentified
  source 1..126: mol_type = other RNA; note = Related to NZ_CP093335.1; note = Sphingopyxis granuli
atgccaacggggtcttccttcgcatacgggctgtgcaactgcggcctaagagcgaatgtctggacacatcgagcgcgcagctctttacggggcgactggcgtgattggaagggagacctcgtgcca

SEQ ID NO: 14693 - RNA, 125 nt, unidentified
  source 1..125: mol_type = other RNA; note = Related to CP038440.1; note = Brevundimonas sp.
agccgggcggggtctcccttcgcatacgggctgtgcaactgcggcctaagagcgaacgtctccacacatcgtgcccgcgcgtgcttcatggcaacctcgcggattggaagggggacctcgtgaca

SEQ ID NO: 14694 - RNA, 124 nt, unidentified
  source 1..124: mol_type = other RNA; note = Related to NZ_CP018171.1; note = Aquibium oceanicum
agctggacggggccactcttcgcatacgggctgtgtaactgcggcctaagagcaaacgtctcgacatatcttgcccgccgagtgcttgtggcgagcggcgtgattggaagggggccccgtgcca

SEQ ID NO: 14695 - RNA, 128 nt, unidentified
  source 1..128: mol_type = other RNA; note = Related to NZ_QAYG01000015.1; note = Breoghania corrubedonensis
cggtctacgaggtctcccctcgcatacgcgctgtgcaactgcggcgtaagagctaatgtctcgatatatcgtgcgcgccatcgtaacctggtgtgacttggcgtgattggaagggagacctcgtgccg

SEQ ID NO: 14696 - RNA, 129 nt, unidentified
  source 1..129: mol_type = other RNA; note = Related to JAIETD010000062.1; note = Methylobacterium sp.
ccgtgtacgaggtctcccttcgcatacgcgctgtgcaactgcggcgtaagagctaatgtctggggataacgtgcgcgccaccctaatcttgtgtgaccgtggcgtgattggaagggagacctcgtgccg

SEQ ID NO: 14697 - RNA, 127 nt, unidentified
  source 1..127: mol_type = other RNA; note = Related to JAFBAI010000383.1; note = Xanthobacteraceae bacterium
acgaccacgaggtctcccctcgcatacgcgctgtgcaactgcggcgtaagagtgaatgtctcgagaggacgtgcgcgccatacggctattacgtgagtggcgtgattggaggggagacctcgtgcca

SEQ ID NO: 14698 - RNA, 127 nt, unidentified
  source 1..127: mol_type = other RNA; note = Related to NZ_CP021912.1; note = Erythrobacter sp.
ccctgggcgggatatctcttcgcatacgcgctgtgcaactgcggcgtaagagctaacgtcaacgcaaatcgtgcgcgccgaggcttctcgggaacccgggcgtgattggaagagatatcccgtgcca

SEQ ID NO: 14699 - RNA, 127 nt, unidentified
  source 1..127: mol_type = other RNA; note = Related to JAGOQV010000032.1; note = Alphaproteobacteria bacterium
tgttttacggggtctcccctcgcatacgcgctgtgataactgcggcgtaagagctaatgtctagtacaaatcgtgcgcgccaacgtgttatgcgtgcttggcgtgattggagggagacctcgtgcat

SEQ ID NO: 14700 - RNA, 128 nt, unidentified
  source 1..128: mol_type = other RNA; note = Related to SUEX01000026.1; note = Mesorhizobium sp.
tcccttacgaggtctcccctcgcatacgcgctgtagtaactgcggcgtaagagctaacgtctgcacagatcgtgcgcgccaatcgactatgcgacacttggcgtgattggaagggagacctcgtgctg

SEQ ID NO: 14701 - RNA, 128 nt, unidentified
  source 1..128: mol_type = other RNA; note = Related to CP019966.1; note = Rhodopseudomonas palustris
ttatgtacgaggtctcccatcgcatacgcgctgtagtaactgcggcgtaagagctaaagtctgtgcaaatcgtgcgcgccacatgcgcaatgcgagcatggcgtgattggaagggagacctcgtaact

SEQ ID NO: 14702 - RNA, 129 nt, unidentified
  source 1..129: mol_type = other RNA; note = Related to NZ_WOAC01000030.1; note = Mesorhizobium sp.
tgcttcacgaggtctcccctcgcatacgcgctgtagtaactgcggcgtaagagctaatgtctgcacatatcgtgcgcgccatatcgacaatgcgacacatggcgtgattggaagggagacctcgtgccg

SEQ ID NO: 14703 - RNA, 127 nt, unidentified
  source 1..127: mol_type = other RNA; note = Related to JAIOIW010000047.1; note = Notoacmeibacter sp.
ttcttcacgaggtttcccctcgcatacgcgctgtagtaactgcggcgttagagctaatgtctgcacatatcgtgcgcgccatgggactcggtacacttggcgtgactggaggggagacctcgtgcca

SEQ ID NO: 14704 - RNA, 128 nt, unidentified
  source 1..128: mol_type = other RNA; note = Related to CP021181.1; note = Rhizorhabdus wittichii
gctgccacgaggtcttccctcgcatgcgcgctgtgcaactgcggcgtaagagctaatgtctaggaagatcgtgcgcgccaggaacccttgggcgaccccggcgtgattggaaggaagacctcgtgccc

SEQ ID NO: 14705 - RNA, 127 nt, unidentified
  source 1..127: mol_type = other RNA; note = Related to QHJY01000004.1; note = Caulobacter sp.
agtcctacgaggtctcccctcgcatccgcgcggtggcaactgccgcgtaagagctcatgtctgcacatatcgtgcacgccacgtactacgggacgatcggcgtgattggaagggagacctcgtgacc

SEQ ID NO: 14706 - RNA, 132 nt, unidentified
  source 1..132: mol_type = other RNA; note = Related to SACP01000011.1; note = Methylobacterium oryzihabitans
ctcagtacgaggtctcccccctcgcatgcgcgctgttgtaactgcggcgtaagagcggatgtctgagtagatagtgcacgccccggtcagcacgatgaccatggcgtgattggagggggagacctcgtgcca

SEQ ID NO: 14707 - RNA, 128 nt, unidentified
  source 1..128: mol_type = other RNA; note = Related to SMAR01000071.1; note = Martelella mediterranea
atcaatgcgaggtctcccctcgcatgcgcgctgtagtaactgcggcgtaagagctaatgatctcagaatatcgtgcgcgtcacgagattatgacgccatgacgtgattggaggggaggcctcgtgccg

SEQ ID NO: 14708 - RNA, 126 nt, unidentified
  source 1..126: mol_type = other RNA; note = Related to NZ_VWNA01000001.1; note = Segnochrobactrum spirostomi
cttggcgcgagatttccgctcgcatacgcgctgtcgtaactgcggcgcaagagctaatgtgtcgagaaaacgggggcgccgtcaatgaggacgccactgcatgactggagcggagatctcgcacca

SEQ ID NO: 14709 - RNA, 128 nt, unidentified
  source 1..128: mol_type = other RNA; note = Related to CP031750.1; note = Cereibacter sphaeroides
tgccatacgaggtgctccctcgcactcgcgttgtcggaactgaaacgcaagacgcaatgaacagcacaagtctgtggcctgcataatctgatatcctatgcatgaatggaggggagcacctcgtgcct

SEQ ID NO: 14710 - RNA, 127 nt, unidentified
  source 1..127: mol_type = other RNA; note = Related to VSSR01000016.1; note = Bradyrhizobium cytisi
taatagaaggagcgccccctcgcataccgcgctgtcgtaactgcggcgtctgactcaacggttggtaacatgattgacggcccgaaatgctttgcatcgggcgagaaggagggggcgccccttttac

SEQ ID NO: 14711 - RNA, 127 nt, unidentified
  source 1..127: mol_type = other RNA; note = Related to JADPJU010000115.1; note = Bradyrhizobium sp.
ttaataatgcagcgccccctcgcataccgcgctgttgaaactgcggcgtttgaatgaatggtacgtcacttgattcgcggcccaatgctatatggcctgggcgagaaggagggggcgctcccttttt

SEQ ID NO: 14712 - RNA, 117 nt, unidentified
  source 1..117: mol_type = other RNA; note = Related to NZ_JYMS01000026.1; note = Bradyrhizobium sp.
gcgaccgcgccccctcgcatgccgctctgtcgtaactgcggagatttgaccgaaaggttctggatatgatcgcggcccgaatgccttgggctcgggcgagaaggagggggcgcactt

SEQ ID NO: 14713 - RNA, 128 nt, unidentified
  source 1..128: mol_type = other RNA; note = Alcaligenaceae bacterium; note = Related to SDYD01000559.1
cttgcgttgaggcctcctcgcattgcgcgctgttggaactgcggcgtctgactcaatgtccggtacaaaaggcccgacgatcgcgacgaatgatcaacaccgtcggagaaggaggaggtctcaccctt

SEQ ID NO: 14714 - RNA, 125 nt, unidentified
  source 1..125: mol_type = other RNA; note = Related to JADCGG010000223.1; note = Roseomonas sp.
atcatactaaggcgtctcctcgcatgacgcgtcgtgttaacgcgacgtttgaccgaatgttacctcaggatgtcgccgttgctttcggcggcttgccggcgatcagaaggaggagacgcctttca

SEQ ID NO: 14715 - RNA, 121 nt, unidentified
  source 1..121: mol_type = other RNA; note = Related to JAIVAG010000015.1; note = Yangia pacifica
tgcgatacgaggccttcctcgcaaaacgtgctgtgtaatcgcggcatgagatgaaaagttcagagaaatctgcgtctcgaacatcaatttccgttcgatgattggagggggcctcgtgcca

SEQ ID NO: 14716 - RNA, 128 nt, unidentified
  source 1..128: mol_type = other RNA; note = Related to NZ_PHJF01000002.1; note = Epibacterium ulvae
ctttgaacgagactctgcctcgcacaacgcgttgtcgtaactgcgacgtgagattaaaagttatactatatcagccaaaccatggtgatttgacacttcatggcgaaaggaggcggtgtctcgtgcca

SEQ ID NO: 14717 - RNA, 144 nt, unidentified
  source 1..144: mol_type = other RNA; note = Related to SZVX01000028.1; note = Dickeya sp.
atacggctctgccttaaatctgtgaggttgtttcgcctcgaggtatctaatgttagcatatcatgccatcgttcatcgaatggttattcgttgtaaaagtttgtcagctatacgttgcgtaaagtgattgggcagggtcgtaat

SEQ ID NO: 14718 - RNA, 145 nt, unidentified
  source 1..145: mol_type = other RNA; note = Related to CP055010.1; note = Klebsiella quasipneumoniae
gcacggctctgccttaaatctgtgaggttgtttcgcctcgaagtatctaatgtcagtacatcatgccaccgttcagccgaatggttactggtcgcaacaggttgttggctttacgttgcgcaaagtgattggacagagccgtaaa

SEQ ID NO: 14719 - RNA, 144 nt, Enterobacter sp.
  source 1..144: mol_type = other RNA; note = Related to CP012871.1
atacggctctgccttaaatctgtgaggttgtttcgcctcgaagtatcttatgttagtacatcacgctaccaatcagcggttagttacttgacgtaactgttaattggctaaagtttgcataaagtgattgggcggagccgtaaa

SEQ ID NO: 14720 - RNA, 147 nt, unidentified
  source 1..147: mol_type = other RNA; note = Related to PDDV01000006.1; note = Edwardsiella tarda
taatgcggcttcgtcttaaattttctaggttgtttcgccttgagagatttaatgtgagcacatcacgccccaatcagcggtcgttacagattgccagttggatagctctatacagatgcgaaaagtgattggacgaagccgcacatt

SEQ ID NO: 14721 - RNA, 146 nt, Citrobacter sp.
  source 1..146: mol_type = other RNA; note = Related to LR134204.1; note = Citrobacter koseri
ttacggctctgccttaaatctgcgaggtcgtttcgcctcgaattatctaacgtaagcaagatcacgcatccgccactctggatgaccgcttgtcgcactctctggattacctccggttgcgcaaggtgattgggcagagccgtaac

SEQ ID NO: 14722 - RNA, 143 nt, Escherichia coli
  source 1..143: mol_type = other RNA; note = Related to CP057087.1
ctacggctctgccttaaatttgtgaggttgtttcgcctcgaaggaactaatgttaggacatacgccaccgttcagtcgatggtaacgcttcttaactagtggtccgctaagtgatgcgcaaagtgattgggcagagccgaaac

SEQ ID NO: 14723 - RNA, 143 nt, unidentified
  source 1..143: mol_type = other RNA; note = Related to NZ_CAKLOR010000001.1; note = Klebsiella variicola
atacggctctgccttaaatttgtgaggttgtttcgcctcgaaggaactaatgttagcacacatgccatcgttcaggcgatggttactggtcgtaacttgatgtcagctatacgttgcgtaaagtgattgggcagagccgaaac

SEQ ID NO: 14724 - RNA, 145 nt, Proteus sp.
  source 1..145: mol_type = other RNA; note = Related to CP063440.1; note = Proteus mirabilis
atacggctccaccttaaatttgtgaggttgtttcgcctcgaaggaactaatgttaagatatatgccgttattctgctgtaaattgttatccatataacggtttttcagctatagattgcgtaaagtgattgggtggagccgtaat

SEQ ID NO: 14725 - RNA, 143 nt, unidentified
  source 1..143: mol_type = other RNA; note = Related to CP082141.1; note = Erwinia persicina
atacggctctgccttaaatttgtgaggttgtttcgcctcgaaggaactaatgttaggacacatgccaccgttcatccgatggttattgttcgcaacgggttgtcagctatacgttgcgcaaagtgattgggcagagccgtatt

SEQ ID NO: 14726 - RNA, 146 nt, unidentified
  source 1..146: mol_type = other RNA; note = Related to CP065673.1; note = Serratia plymuthica
gtacggctctgccttaaattttcaaagttgtttcgctttgaagtagtaaatgtgtggacatcatgcccctgtcagctgtgccgcgaaatgggctacaccagattggcgcgttggttttgcgtaaagtgattgggcagagccgatca

SEQ ID NO: 14727 - RNA, 145 nt, unidentified
  source 1..145: mol_type = other RNA; note = Related to CP065717.1; note = Serratia rubidaea
gtacggctctgccttaaattttcaaagttgtttcgctttgaagtagtaaacgagtggatatcatgccttatcagcgtcatgctaaatgggttacgccaggtagtatcgccgggttttgcgtagagtgattgggcagagccgtttg

SEQ ID NO: 14728 - RNA, 140 nt, unidentified
  source 1..140: mol_type = other RNA; note = Related to HG427573.1; note = Xenorhabdus bovienii
tactggctctgccttaaattttcaaagttgtttcgctttgaagtaaataatgtgaggttatcatgcctactgaacatggtggttacaccatgggttaacacgaaatttgtgtgcatagagtgattgggcagagccgcttt

SEQ ID NO: 14729 - RNA, 154 nt, unidentified
  source 1..154: mol_type = other RNA; note = Related to QRAU01000016.1; note = Serratia fonticola
agatggctccaccttaaattttcaaagttgtttcgctttgattttagcaaggttagtagaaatgccctgctccagggttgctgattgtccgcaaagttgcttcgtgagcttagcgtccttaggattgcgtaaggtgattgggtggagccactat

SEQ ID NO: 14730 - RNA, 154 nt, unidentified
  source 1..154: mol_type = other RNA; note = Related to NZ_CABHYS010000030.1; note = Yersinia mollaretii
aaaaggctccaccttaaattttcaaagttgtttcgctttgatttcaataacgtgagtagatatgccctgttaagggttgctgattgcccgctaagttgcttaataatcttagcgagcttatagtttgcgtaaggtgattgggtggagccaccct

SEQ ID NO: 14731 - RNA, 148 nt, unidentified
  source 1..148: mol_type = other RNA; note = Related to LKDX01000002.1; note = Pseudoalteromonas sp.
ctcggtttcgacccaaaatgtctgaagttgtaactgctttggatttggaacacaggctagcaaatgctgccggctatactcttatggctatctttatcgaattgctcgatgtcttaattggcgcaaggtgattgggtcgaaaccacta

SEQ ID NO: 14732 - RNA, 144 nt, unidentified
  source 1..144: mol_type = other RNA; note = Related to NZ_BLPI01000001.1; note = Agarivorans litoreus
cttggtttcaacccaaaatgtctgaagttgttactgcttcggacttggaactccgggtaacatatgctcggctacaactgtatctgatgttatcgatttgctcgatggctcaaatggcgcaaggtgattgggttgaaaccattt

SEQ ID NO: 14733 - RNA, 148 nt, Aeromonas salmonicida
  source 1..148: mol_type = other RNA; note = Related to NZ_CP051883.1
tacggtttcagccctaaatgtctgaagttgttactgctttggacttggaataccgggtaacacatgcccacggttcatctttatcggattgcctcgattcattcgattcgccgcgtggtggcgtaaggtgattgggctgaaaccactt

SEQ ID NO: 14734 - RNA, 144 nt, unidentified
  source 1..144: mol_type = other RNA; note = Related to NZ_CP033065.1; note = Pseudoalteromonas agarivorans
actggtttcgacccaaaatgtctgaagttgttaccgctttagattaggaactctgggtaggatatgcctgtgtgaactttatcagattgcttccaattatctgattggctctaagtgcgcaaagtgattgggttgaagccgtta

SEQ ID NO: 14735 - RNA, 151 nt, Vibrio sp.
  source 1..151: mol_type = other RNA; note = Related to VFNK01000001.1; note = Vibrio crassostreae
tgtggtttcaacccaaaatgtctgaagttgttactgctttggacttgtaactcagggtaactcatgcccgatgatctcgactttaccggatgcacatgatgtatacgggttgcctttaaggtggcgcaaggtgattgggttgaaaccatta

SEQ ID NO: 14736 - RNA, 147 nt, unidentified
  source 1..147: mol_type = other RNA; note = Related to NZ_PNCO02000001.1; note = Pseudoalteromonas galatheae
gttggcttcaacccaaaatgtctgaagttgttactgctttggacttggaaatcagggtagcatacgctcgatgtaagaggggcgctttactccaataatattggatgtgtcgcaagcctgcgcaaagtgattgggttgaagccacta

SEQ ID NO: 14737 - RNA, 147 nt, unidentified
  source 1..147: mol_type = other RNA; note = Related to NZ_JXXX01000040.1; note = Pseudoalteromonas piscicida
attggcttcaacccaaaatgtctgaagttgttactgctttggacttggaaatctgggtagcatacgctcgatgtaagaggggcgctttactccaataatattggatgtgttgcaagcctgcgcaaagtgattgggttgaagccacta

SEQ ID NO: 14738 - RNA, 141 nt, Vibrio parahaemolyticus
  source 1..141: mol_type = other RNA; note = Related to CP040101.1
aatggcttcggcccaaactgtctaaagttgttactgctttggactagggactctgagttccatatgccatcctgacgattggatgatatctctatgctgcatgtagcggaaaggcgcaaggtgattgggctgaagccaagc

SEQ ID NO: 14739 - RNA, 156 nt, unidentified
  source 1..156: mol_type = other RNA; note = Related to JACXAF010000008.1; note = Neiella sp.
atgggtttcaacccaaaatgtctgaagttgttactgctttggactaggaattccgagaacattatgctcattaaatctgcataagcccaagggggctgtcgtgattgatgggttgcttgccgcaaggtgcgcagggtgattgggttgaaactcgcc

SEQ ID NO: 14740 - RNA, 147 nt, Aeromonas sp.
  source 1..147: mol_type = other RNA; note = Related to NZ_LKJS01000005.1; note = Aeromonas veronii
tttgggctcaaccctaaatgtctgaggttgttactgctttggactaagatatgcgagtacattatgcctgctgaggcgtgctcaccgggtgagcgccaatttgcactggtcgctcaggtgcgtaaggtgattgggttgagcccactc

SEQ ID NO: 14741 - RNA, 134 nt, unidentified
  source 1..134: mol_type = other RNA; note = Related to NZ_VISO01000003.1; note = Rhizobium mongolense
cgaggcttgaccctctagttggtgccggtgaattcacggcaactcgctgaaacgtcagtacacatccgcgcgggccggtgcgctatgctcgatgcggtgacacgggaaggtacagagcgagggtcaagccttga

SEQ ID NO: 14742 - RNA, 130 nt, unidentified
  source 1..130: mol_type = other RNA; note = Related to NZ_JABFCN010000062.1; note = Rhizobium sophorae
aggcttggccctctaatttgtgccggtgaattcacggcaactcgctgagacgtcagtacacaaccgcgcgggccgggcgattgctcaaacggtgcaccacgggaatggtaaagagcgagggccaagcctt

SEQ ID NO: 14743 - RNA, 133 nt, unidentified
  source 1..133: mol_type = other RNA; note = Related to JAAXST010000004.1; note = Rhizobium laguerreae
tgaggcttgaccctctagtttgtgccggtgaattcacggcaactcgctgaaacgtcagtacacaatcgcgcgccggctctgcggcaacacacgcggttccacggaaaggtaaagagcgagggtcaagccttga

SEQ ID NO: 14744 - RNA, 127 nt, unidentified
  source 1..127: mol_type = other RNA; note = Related to JAHBRY010000004.1; note = Chelatococcus asaccharovorans
agacttggccctctagttggagccggtgtatccacggctgctcgacgaaaagttagtccataaggcgtgcgcggcggtccgtcgacgcgtactacctgcatcaggtaaggagcgagggccaagtctt

SEQ ID NO: 14745 - RNA, 131 nt, unidentified
  source 1..131: mol_type = other RNA; note = Bdellovibrionales bacterium; note = Related to JAGRAU010000490.1
agacttagccctctagttggagccggtgaattcacggctactggtaggaatgttactccataccgcgccgcgtgccgtggtgcgacaacgggtgatccacgttgagaagtaaagagcgagggctaagtctt

SEQ ID NO: 14746 - RNA, 128 nt, unidentified
  source 1..128: mol_type = other RNA; note = Related to NZ_KB890024.1; note = Hoeflea sp.
aggcttggccctctagttggagccgttgaatccacggctactcgctgaaatgtcatttcacaacgtcgtgccggccgggctgaccggaccgtgacccgttgaaaggtaaagagcgagggccaagcctt

SEQ ID NO: 14747 - RNA, 133 nt, unidentified
  source 1..133: mol_type = other RNA; note = Related to NZ_MYFQ01000014.1; note = Shinella sp.
agaagcttgaccctctaattggtaccggtgaatccacggtagctcgctataatgtcagtacacattcccgcgcgccggccgaataagccgtgcgatcggcgatgaaaggtaaagatcgagggtcaagcatttt

SEQ ID NO: 14748 - RNA, 131 nt, unidentified
  source 1..131: mol_type = other RNA; note = Related to NZ_CAKKMZ010000001.1; note = Rhizobium sp.
gtagcttgaccctctaattggtgccggtgaatccacggcaactcgctataacgtctgtacacatgcgcgcgggccggcgtgaccaaacaccggcaagcccaacgaaggtaaagatcgagggtcaagctttc

SEQ ID NO: 14749 - RNA, 134 nt, unidentified
  source 1..134: mol_type = other RNA; note = Related to NZ_AQQR01000002.1; note = Marinibacterium profundimaris
gaaggtccggctctctaatttccgctggtgaatccccggtggctcgctgaaacgttggtccaaaatcgcgacggtccgacggataatcgttccttagacgctgatgaaggtagagaacgagggttgggccttcc

SEQ ID NO: 14750 - RNA, 133 nt, unidentified
  source 1..133: mol_type = other RNA; note = Related to CP010623.1; note = Phaeobacter inhibens
caaggctcaactctctagtttgcgctggtgaatccccggcggctcgctgaaacgttagtcctaaatcgcggcggcgcggtgggttgtccactgtgtatcgtcgataaggtagagaacgagggttgagccttcc

SEQ ID NO: 14751 - RNA, 134 nt, unidentified
  source 1..134: mol_type = other RNA; note = Related to SMSI01000004.1; note = Pseudohoeflea suaedae
cgacgcttgctcctctacttggtgccgttgaatccacggcatatggctgaacgttcagtacacaaccgcgcgcgccggcgttatggccaaccggggtgctcgaatcgaggtaaagaacgaggagcaagctttgc

SEQ ID NO: 14752 - RNA, 126 nt, unidentified
  source 1..126: mol_type = other RNA; note = Related to JAGHRO010000004.1; note = Shimia sp.
gtgctcgaccctctacttggggctgtagaatccacggctgcttattgtaaagtcagtacacagttggttgactcctgtgcaatgtgagagtcaccgatgaaaagtaaagagcgagggtcgagccaa

SEQ ID NO: 14753 - RNA, 132 nt, unidentified
  source 1..132: mol_type = other RNA; note = Related to NZ_JFZB01000068.1; note = Paenirhodobacter enshiensis
gcagctcgaccctctacttggggctgttgaatccacggctgcttattagaatgtcagtacacaatcgcgcggcgcggtccgtgcgacatgtgtgatacccgatgcaaggtaaagagcgagggtcgagctgat

SEQ ID NO: 14754 - RNA, 133 nt, unidentified
  source 1..133: mol_type = other RNA; note = Related to FOXV01000005.1; note = Roseivivax halotolerans
ttagctcggccctctacttggggctgtagaatccacggctgcttattgaaatgtctatacataatcgcgcggccggtcggtgtgattcagccggatgcgtgtggataaggtaaagagcgagggtcgagctgat

SEQ ID NO: 14755 - RNA, 150 nt, unidentified
  source 1..150: mol_type = other RNA; note = Related to JAINWD010000002.1; note = Halomonas sp.
acaagcacccctcaagctttaactatgcagtgcaaccactgcaatcatccttaatgtaaggacatatgctactatggattacgttgagactgtaatacgcaatattacgaggtctcgcgaggcgtaaggtaaatagcaggggtgcttttt

SEQ ID NO: 14756 - RNA, 152 nt, Pseudomonas sp.
  source 1..152: mol_type = other RNA; note = Related to NZ_QBEO01000006.1; note = Pseudomonas aeruginosa
cgcagcacccctccaagctttaactatgcagtgctaccactgcaatcatcgttaatgtaaggatatatgcgactgtggatttcgatgggactaatgattcgcaatgttatgagtctcgcgaggcgtaaggtaaatagcggggggtgctgctt

SEQ ID NO: 14757 - RNA, 152 nt, Pseudomonas sp.
  source 1..152: mol_type = other RNA; note = Related to NZ_NEIO01000001.1
gcatgcacccctccaagctttaactatgcagtgcgaccactgcaatcattcgttaatgtaaggatatatgctactgtgagttacgttgagactatagttcgcaatgttatgagtctcgcgaggcgtaaggtaaatggcggggggtgctgctt

SEQ ID NO: 14758 - RNA, 152 nt, Pseudomonas sp.
  source 1..152: mol_type = other RNA; note = Related to NZ_CP009747.1; note = Pseudomonas parafulva
caaagcacccctccacgctttaactatgcagtgcgaccactgcaatcatcgttaatgttaggacatatgctactgtgagtgacgttgagactaatgattcggaatgttacgagtctcgcgaggcgtaaggtaaatggcggggggtgctactt

SEQ ID NO: 14759 - RNA, 151 nt, Pseudomonas sp.
  source 1..151: mol_type = other RNA; note = Related to NZ_CP075180.1; note = Pseudomonas lundensis
gagggcacccctccaagctttaactatgcagtgctaccactgcaatgatcgttaatgtaaggacatatgctactgtgagttacgctgagactatcgattcgcaatgttatgagtctcgcggggcgtaaggtaaatagcgggggtgccgctt

SEQ ID NO: 14760 - RNA, 149 nt, Pseudomonas sp.
  source 1..149: mol_type = other RNA; note = Related to NZ_JYKS01000054.1
acaggcacccctccaagctttaactatgcagtgctaccgctgcaatgatcgttaatgtaaggacatatgctactgagagttacgtcgaggcttcttcgcaatgttagcggtctcgcggggcgtaaggtgaatagcggggggtgccgctt

SEQ ID NO: 14761 - RNA, 150 nt, Pseudomonas sp.
  source 1..150: mol_type = other RNA; note = Related to RHQN01000003.1
ctaggcacccccaacagctttaactatgcagtgtgaccactgcaatgatctttgatgtatgcacaaatgccactcgggttacgccatgacccttggaggttacgttacggttcgtgatgggcgtaaggtaaatagcggggggtgccgctt

SEQ ID NO: 14762 - RNA, 155 nt, Pseudomonas sp.
  source 1..155: mol_type = other RNA; note = Related to CP013124.1; note = Pseudomonas mendocina
aagggctccccccacagctttaactatgcagtgctacctactgcaaaaatctgtcaagttcccacatacgccaccttagcggactcgcgacgttggcggcctattgatcgttacggttgactagggcgtaaggtaaaaggcagggggagcccttt

SEQ ID NO: 14763 - RNA, 154 nt, unidentified
  source 1..154: mol_type = other RNA; note = Pseudomonadaceae bacterium; note = Related to JAAYGA010000118.1
gggctcctgtccaaaagctttaactatgcagtgctacctactgcaaaaatctgttatgttttcccatatgctactttcgcgacttagcaagttggcgacctatcaatcattacggttgactcaggcgtaaggtaaaaggcgggagaggagccct

SEQ ID NO: 14764 - RNA, 155 nt, Pseudomonas sp.
  source 1..155: mol_type = other RNA; note = Related to NZ_SULN01000012.1; note = Pseudomonas rhizoryzae
ggggctcctccctacagctttaactatgcagtgctacctactgcaaaaatctttcatgtacacccatacgctgcactcgcggtatcgctatgcggcggcctttcgattgtagtggtcgacaagggcgtaaggtaaaaggcaagggaggagcccct

SEQ ID NO: 14765 - RNA, 117 nt, unidentified
  source 1..117: mol_type = other RNA; note = Related to JADMJM010000027.1; note = Hyphomonadaceae bacterium
aagcatcccgtccttctacgtccgctgttgatcctgcggcggaacagacaatgctcctctttaaggcccctgcacgagtgcaggggccttcgtaaggtacgagggacgggatgcctt

SEQ ID NO: 14766 - RNA, 117 nt, unidentified
  source 1..117: mol_type = other RNA; note = Related to JAEUMP010000020.1; note = Hyphomonadaceae bacterium
aagcatcccgtccttctacgtccgctgtcgatcctgcggcggaacagacaatgctccactttaaggcccctgcacgggtgcaggggccttcgtaaggtacgagggacgggatgcctt

SEQ ID NO: 14767 - RNA, 119 nt, unidentified
  source 1..119: mol_type = other RNA; note = Alphaproteobacteria bacterium; note = Related to WGOB01000084.1
aggcatccggtccttctacgtccgctgtcgatcctgcggcggaacaacaaatgtcgatctttaggagtacggggctgaagccccgtactcctagtaaggtacgagggacgggatgcctc

SEQ ID NO: 14768 - RNA, 118 nt, unidentified
  source 1..118: mol_type = other RNA; note = Hyphomonadaceae bacterium; note = Related to JAEUMQ010000020.1
gcgcatcccgtccttctacggccgctgtcgatcctgcggcggaacaaacaatgtctgtctttgacacacccgtcacaaggacgggtgtgcccgtaaagtacgagggacgggatgcagc

SEQ ID NO: 14769 - RNA, 121 nt, unidentified
  source 1..121: mol_type = other RNA; note = Related to WGNI01000003.1; note = Alphaproteobacteria bacterium
aggcatcccgcccttctacgtccgttgtcgatcctgcgacggaacaaacaatgtcggtctttagactacccgtgcgcaagcgcacgggtagtctggtaaggtacgagggacgggatgccgg

SEQ ID NO: 14770 - RNA, 114 nt, unidentified
  source 1..114: mol_type = other RNA; note = Hyphomonadaceae bacterium; note = Related to JAEUMS010000023.1
aagcatcctgtccttctacgtccgctgttgatcctgcggcggaataaataaggtgcgtctttaaacccagcgctaaagcgcgggtttggtaaggtacgagggacgggatgcctt

SEQ ID NO: 14771 - RNA, 114 nt, unidentified
  source 1..114: mol_type = other RNA; note = Related to DPWD01000203.1; note = Hyphomonadaceae bacterium
aagcatcccgtccttctaagtccgctgttgatcctgcggcggaataaataaggtgcgtctttaaacccagcgcttaagcgcgggtttggtaaggtacgagggacgggatgcctt

SEQ ID NO: 14772 - RNA, 113 nt, unidentified
  source 1..113: mol_type = other RNA; note = Related to NZ_SBJL01000001.1; note = Vitreimonas flagellata
aggcatctcgtccttctacgtctgctgttgatcctgcggcagaacaaacaacgtctgtctttatacccagccctgcgggcgggtatcgtaaggtacgagggacgggatgcctc

SEQ ID NO: 14773 - RNA, 118 nt, unidentified
  source 1..118: mol_type = other RNA; note = Alphaproteobacteria bacterium; note = Related to JAGWZE010000002.1
gagcatcccgcccgtctaagtccgctgtcgatcctgcggcggaaagtcaaacgcccatcttcaaggccatgggccaaggcccatggccttgcctaaggtacgaggggcgggatgctct

SEQ ID NO: 14774 - RNA, 122 nt, unidentified
  source 1..122: mol_type = other RNA; note = Related to JAHQVS010000037.1; note = Rhodobacteraceae bacterium
gcagccccgctcctctatgttcgctgttgatcctgcggcgtaagtagaattgcacacttttactagggggaccgcgtgaacgcggtccccctagtaattaaggtacgaggagtggggcatct

SEQ ID NO: 14775 - RNA, 118 nt, unidentified
  source 1..118: mol_type = other RNA; note = Related to JAHJSN010000196.1; note = Alphaproteobacteria bacterium
aggcatcctgcccttctacgtctgctgttgatcctgcggcagaaaaatcaaagtcttcttttaactatgggccgtaaacggcccatagttacataaggtacgaggggcaggatgcctg

SEQ ID NO: 14776 - RNA, 125 nt, unidentified
  source 1..125: mol_type = other RNA; note = Alphaproteobacteria bacterium; note = Related to JAGWZH010000139.1
gcgcgccgcccttctacgtccgctgttgttcctgcggcggaataaacaatgtctcactttacccaagggccgggcccgctcgcggccccggccctagggccccaaggtacgaggggcggcgtgtt

SEQ ID NO: 14777 - RNA, 184 nt, unidentified
  source 1..184: mol_type = other RNA; note = Planctomycetaceae bacterium; note = Related to JAGQQN010000044.1
aaacgacttccacttacctgtttgggctgttgatcctgcagcttgatcgtaaatgtatctttagtacgtcaactcagactctgcttgttcctaagtgtctctaaggcatcctgcggaaggcacctaatggtgctgtagtctttcagaagctgagatgttcggtaagagaaagtgggagcgtttc

SEQ ID NO: 14778 - RNA, 140 nt, unidentified
  source 1..140: mol_type = other RNA; note = Related to MDHN01000015.1; note = Alteromonas confluentis
ggagattgggtgcccatgatttacctttcttatgctatctgcgtaagtattaaaacaacggcatttttgccgctcatcgattactcttaaaggccattcgcccggcagaggtaaagataaaatcgggcacccaatcttat

SEQ ID NO: 14779 - RNA, 139 nt, unidentified
  source 1..139: mol_type = other RNA; note = Related to QJST01000027.1; note = Idiomarina fontislapidosi
atttgcgggtgaacagaatttactttccttatgcttatcagcataagagttaaataacggcatttttgccgtttatctgattactctaagtgttaagttgtcttatagaggtaaagagaaaatagttcacccgcagttt

SEQ ID NO: 14780 - RNA, 129 nt, Vibrio sp.
  source 1..129: mol_type = other RNA; note = Related to JTKH01000003.1; note = Vibrio renipiscarius
gcaagaggcgagagtttaactttctgctgttaatctgcggcggtcataagcatgtttctttttaccggtcctcagctagcctgatgatgccgttacgctgtacaagagaaaacaaaatcgcctcgttct

SEQ ID NO: 14781 - RNA, 128 nt, unidentified
  source 1..128: mol_type = other RNA; note = Related to NZ_LSNH01000001.1; note = Photobacterium sp.
caaagaggcgagagtttaactttctgctgttaatctgcggcggtcataagcatgtttctttttccggttgtcatctaaaatgttgcagccgttacgctgtataagagaaaacaaaatcgcctcgtttt

SEQ ID NO: 14782 - RNA, 131 nt, Vibrio parahaemolyticus
  source 1..131: mol_type = other RNA; note = Related to ABBBER010000002.1
cgaagaggcgaaaggtttaactttctgctgtctatctgcggtggtcatgaaaatgtttctttttccccgtgtatgtcacacttgtggcgtcatggtactcgatataagagaaaacaaaatcgcctcttcac

SEQ ID NO: 14783 - RNA, 137 nt, unidentified
  source 1..137: mol_type = other RNA; note = Related to NZ_CABHZI010000111.1; note = Yersinia proxima
cagcgcattttatcacaatttaactttctactgactatctgcggtagccataaacatgtaacttctgcatcggccgactttccgtatctcgcatgtttgccgaatttgcaaaagagaaaatagataaagtgcgctgt

SEQ ID NO: 14784 - RNA, 134 nt, Pseudomonas sp.
  source 1..134: mol_type = other RNA; note = Related to NZ_AWSQ01000001.1; note = Pseudomonas taeanensis
tcgggttcggggcacaatttaactttccactgactatatgcggtggccactgtaagggtagctttgcctgatcgtgctatacggttacgttatcgatggcgacggtaaaagagaaaatagccccgaaacccggt

SEQ ID NO: 14785 - RNA, 134 nt, Pseudomonas sp.
  source 1..134: mol_type = other RNA; note = Related to CP026558.1; note = Pseudomonas amygdali
ccgggttcggggcacaatttaactttccactgactatatgcggtggccactgcaagggtagctttgcctgatcgcgctatacggttacgttatcgatggcgacggtataagagaaaatagccccgaaacccggt

SEQ ID NO: 14786 - RNA, 136 nt, Pseudomonas fluorescens
  source 1..136: mol_type = other RNA; note = Related to CABVIC010000001.1
tcgggctcggggcaaaaatttaactttccactgactatatgcggtggccaatgcaagggttgctttgccttatcgctcttaacgatattgttaacgttggcgatgtgtagaagagaaaatagccccgaagctcggt

SEQ ID NO: 14787 - RNA, 135 nt, Pseudomonas sp.
  source 1..135: mol_type = other RNA; note = Related to NZ_CP054866.1; note = Pseudomonas chlororaphis
ccgggctcggggtacgatttaactttccactgactatatgcggtggccaatgcaagggtagctttgcctattcgcgcttaacgatgttgttaacgttggcgatgtgtaaaagagaaaatgaccccgagacccggt

SEQ ID NO: 14788 - RNA, 135 nt, Pseudomonas sp.
  source 1..135: mol_type = other RNA; note = Related to MOAT01000002.1; note = Pseudomonas protegens
ccggggtcggggcacgatttaactttccactgactatatgcggtggccagcgcaaggctagctttgcccgttacgcacttacgatgtcgacgaggttgccgatgtgtaaaagagaaaacagccccgacgcccggt

SEQ ID NO: 14789 - RNA, 137 nt, Pseudomonas sp.
  source 1..137: mol_type = other RNA; note = Related to NZ_FNBM01000007.1; note = Pseudomonas seleniipraecipitans
ccgggggcagggcccaatttaactttctgctgactatatgcggcggctaatgtaaggggggctttgcccgttacgttctcacagtgggttacgaattggcaatgtgggtaaaagagaaaattgccctgactcccggt

SEQ ID NO: 14790 - RNA, 136 nt, Pseudomonas sp.
  source 1..136: mol_type = other RNA; note = Related to AJXE01000010.1; note = Pseudomonas stutzeri
tcgggtgtaggggcacaatttaactttccactgactatatgcggtggccaagtaaagggttgctttgccgttacgcgctgacggtttctcacggttggcgacgtatgtaaaagagaaaatagtccctacactcggt

SEQ ID NO: 14791 - RNA, 136 nt, Pseudomonas sp.
  source 1..136: mol_type = other RNA; note = Related to NZ_QJUN01000007.1; note = Pseudomonas dryadis
ccgggtgtagggacgcaatttaactttccactgactatatgcggtggccagataaagggttgctttgccgttacgcgctaacgattactcatggttggcgacgtgtgtaaaagagaaaatagtccctgcactcggt

SEQ ID NO: 14792 - RNA, 137 nt, Pseudomonas fluorescens
  source 1..137: mol_type = other RNA; note = Related to NZ_CP075566.1
tcgggtgtagaggcacaatttaactttccactgactatatgcggtggccacatgaagggttcctttgccgttacgcgctgacgattactatgaggttggcgacgtgtgtaaaagagaaaatagcctctgcacccggt

SEQ ID NO: 14793 - RNA, 134 nt, Pseudomonas sp.
  source 1..134: mol_type = other RNA; note = Related to NZ_KE695189.1; note = Pseudomonas syringae
tccggatgtgggggagatttaactttctgctgttaatctgcggtggcttcgtaaaagtgtcttttgctctttcggcttttcagaggtttgaatggtctcgatggatataagagaaaacaccccacattccggac

SEQ ID NO: 14794 - RNA, 135 nt, Pseudomonas sp.
  source 1..135: mol_type = other RNA; note = Related to NZ_UUIZ01000014.1; note = Pseudomonas viridiflava
gcccgatgtggagggcgatttaacttactgctgactctctgcggcggacatcggaaggcttcttttgcccatcgatatttgttaacaatatgatctcgttacgttgtacaagagaaaacacctccacatcgggca

SEQ ID NO: 14795 - RNA, 138 nt, Pseudomonas sp.
  source 1..138: mol_type = other RNA; note = Related to JAEIKZ010000029.1; note = Pseudomonas corrugata
cccgacggtggggggcgatttaactttccgctgactgtctgcagtgggtaactcaacggttgcattctgcttgtttgagctcaatgttctggatgttgtcgctcagtgatacaagagaaaacatccccaccgtctggc

SEQ ID NO: 14796 - RNA, 135 nt, unidentified
  source 1..135: mol_type = other RNA; note = Related to SMFU01000008.1; note = Marinobacterium mangrovicola
cgagcgaggggctctgatttaactttccgctgactatctgcggcggtaattattacgtttcttttgcagctcggcctcctgggatgcgctgacgatgtgctgcagtgtataagagaaaattagccccttgttcgt

SEQ ID NO: 14797 - RNA, 129 nt, unidentified
  source 1..129: mol_type = other RNA; note = Related to DUBU01000004.1; note = Micavibrio sp.
cagcatatgagggcagagtttaactttccattgttaatctgcaatgtgtcaaaacaatgtttcttctggccgcacaacgcgtgtgtaagccgtaccgctgtacaagagaaaacagccctcgtatgcatt

SEQ ID NO: 14798 - RNA, 127 nt, unidentified
  source 1..127: mol_type = other RNA; note = Related to CP016868.1; note = Legionella pneumophila
cgtggcggtatgaattaaatttccattgtctatctgcgatggttataagtatgttatctattacgctcagtattattactaaactgttattgcagctaagggtataagaaaaattctaccgccaatt

SEQ ID NO: 14799 - RNA, 126 nt, Acinetobacter sp.
  source 1..126: mol_type = other RNA; note = Related to NZ_NHRP01000030.1
aagtctatcacttttaattaatttctattgtgtattcgcaatggtcaatttcaatgtcagtaacatcttcgagacttcatcgacgacagtgatttcgtcgtagaaaaattttaagtgatagatttt

SEQ ID NO: 14800 - RNA, 134 nt, Pseudomonas sp.
  source 1..134: mol_type = other RNA; note = Related to NZ_MOBC01000433.1; note = Pseudomonas brassicacearum
cttagcctccattcaggtattaaatagggttgttcaaatgcgacccgattcaaaaacgccacaagcaacggcgctgagctactcggagacgttatgcttaaaggaatatggtgaaatatgaatggaggcttttt

SEQ ID NO: 14801 - RNA, 134 nt, Pseudomonas sp.
  source 1..134: mol_type = other RNA; note = Related to NZ_LJRZ01000537.1
cctggcctccattcaggtattaaatagggttgttcaaatgcgacccgattcaaaaaagccacaagcaacggcactgagcaactctgcgacgttatgcttaaaggaatatggtgaaatatgaatggaggcttctt

SEQ ID NO: 14802 - RNA, 134 nt, Pseudomonas sp.
  source 1..134: mol_type = other RNA; note = Related to NZ_BCBD01000043.1
ctttgcctccattcaggtattaaatagggttgttcaaatgcgacccgattcaaaaaagccacaagcaacggcactcagcgactctgagacgttacgctcaaaggaatagggtgaaatatgaatggaggcttttt

SEQ ID NO: 14803 - RNA, 134 nt, Pseudomonas sp.
  source 1..134: mol_type = other RNA; note = Related to PVUL01000002.1; note = Pseudomonas simiae
cccagcctccattcaggtattaaatagggttgttcaaatgcgacccgattcaaaaaagccacaagcaacggcgatgagcgactctgagacgttatgcttaaaggaatagggtgaaatatgaatggaggcttctt

SEQ ID NO: 14804 - RNA, 134 nt, Pseudomonas sp.
  source 1..134: mol_type = other RNA; note = Related to NZ_LMGK01000001.1
cccagcctccattcaggtattaaatagggttgttcaaatgcgacccgattcaaaaaagctacaagcaacggcccttagcgacttcgggacgttatcttcaaaggaatagggtgaaatatgaatggaggcttttt

SEQ ID NO: 14805 - RNA, 133 nt, Pseudomonas fluorescens
  source 1..133: mol_type = other RNA; note = Related to SMCJ01000008.1
ctcggcctccattcgggtattaaatagggttgttcaaatgcgacccggctcaaaaatgctacaagcaacatccctttgcgactctggggaattatctttaaacgataaggtgaaatatgaatggaggtttttt

SEQ ID NO: 14806 - RNA, 134 nt, Pseudomonas sp.
  source 1..134: mol_type = other RNA; note = Related to NZ_BQIA01000029.1; note = Pseudomonas otitidis
aaaagcctccattcagatattaaatagggttgttcaaacgcgacccaactcaaaaatgccacaagcaacagctagcagaaatcatcctagcgattaccctaaatgagtaaggtgaaatagaatggaggcttttt

SEQ ID NO: 14807 - RNA, 134 nt, Pseudomonas sp.
  source 1..134: mol_type = other RNA; note = Related to NZ_NEIR01000012.1
tgttgcctccatccaggtattaaattgggttgttcaaacgcgaccctcctcgaaaatgctgtaagcaagatcgcgatgatgaactctgaacgatactctgaatgaatagggtgaaatatggatggaggcacttt

SEQ ID NO: 14808 - RNA, 133 nt, Pseudomonas sp.
  source 1..133: mol_type = other RNA; note = Related to NZ_JABWRZ020000002.1; note = Pseudomonas oryzicola
tctcgcctccatccaggtattaaattgggttgttcaaacgcgaccctacacgaaaacgctatacgcaacatcgcgatgataactctggacgatactctgaacgaatagggtgaaatatggatgggggcatcct

SEQ ID NO: 14809 - RNA, 133 nt, Pseudomonas sp.
  source 1..133: mol_type = other RNA; note = Related to JAAFOZ010000019.1; note = Pseudomonas savastanoi
acgtgccccatccaggtattaaattgggttgttcaaacgcgaccctacacgaaaatgctataagcaacatcgcgccggataactctggacgatactctgaaggaatagggtgaaatatgggtggggtcttttt

SEQ ID NO: 14810 - RNA, 136 nt, Pseudomonas sp.
  source 1..136: mol_type = other RNA; note = Related to NZ_CP081943.1
caacgcctccattcaagtattaaatcgggttgttcaaatgcgacccagctcagaaacgctataagcaacatcgcgatgtgaatcactcatgatgttatcttaaaggaataaggtgaaatatgaatggaggtttttt

SEQ ID NO: 14811 - RNA, 140 nt, Pseudomonas sp.
  source 1..140: mol_type = other RNA; note = Related to NZ_QYYB01000004.1
tagcgtccccgtccagggattaacatgggttgttcaaatgcgacctggctcaataatgtgacatgcaaaagcggtgggtcgacgagtgttattcggcggtccgcgatgatgtaaggtgaaactatggacggggacatctc

SEQ ID NO: 14812 - RNA, 145 nt, Pseudomonas sp.
  source 1..145: mol_type = other RNA; note = Related to NZ_LGLH01000057.1; note = Pseudomonas syringae
acacgcccccgtccgggattaaacttggttgatttaaatgcgaccataaggaacaatgctacaagcaactgctcagctatctgcaaatggttagctggatggataactcgtgaggaatagggtgaaatatggacgagggctcttt

SEQ ID NO: 14813 - RNA, 145 nt, Pseudomonas sp.
  source 1..145: mol_type = other RNA; note = Related to NZ_UWFG01000172.1; note = Pseudomonas viridiflava
gattgccctcgtccgggattaaacttggttgatttaaatgcgaccataaggaacaatgctacaagcaactgctcagcgttctgctaatggtccgctgaatggataactcgaagtgaatagggtgaaatatggacgagggctcttc

SEQ ID NO: 14814 - RNA, 145 nt, Pseudomonas sp.
  source 1..145: mol_type = other RNA; note = Related to NZ_CM001514.1; note = Pseudomonas synxantha
cattgccctcgtccgggattaaacttggttgatttaaatgcgaccataaggaacaatgctacaagcaactgctcagcgttctgctaatggtccgctgaatggataactcgaagtgaatagggtgaaatatggacgagggctcttc

SEQ ID NO: 14815 - RNA, 147 nt, Pseudomonas sp.
  source 1..147: mol_type = other RNA; note = Related to NZ_RWIM01000011.1
tgttgtccccgtccagggattaaaattggttgttttaaatgcgaccgtaaggaacaatgttacaagcaactgcctcagcgttacgctacattgacgccaagtggttaactgtaagtgaatagggtgaaatatggacgggggcatttc

SEQ ID NO: 14816 - RNA, 136 nt, Pseudomonas sp.
  source 1..136: mol_type = other RNA; note = Related to RBNR01000201.1; note = Pseudomonas syringae
gcatccctcgcttacgattaaactgggttgttcaaatgcgacccgattcagcaatgctagaagcaatagccgtggttacattggctttacgatgatacctatgagtctatagggtgaaacgaaggcgagggatgca

SEQ ID NO: 14817 - RNA, 141 nt, Pseudomonas sp.
  source 1..141: mol_type = other RNA; note = Related to NZ_WLYI01000015.1; note = Pseudomonas karstica
gtgcatcccttgcctacgattaaactgggttgttcaaatgcgacccgattcagcaatgctagaagcaacagccagtggttccattggctttacgatgatacctatgagtctatagggtgaaacgcaggcgagggatgcatt

SEQ ID NO: 14818 - RNA, 139 nt, Pseudomonas sp.
  source 1..139: mol_type = other RNA; note = Related to NZ_FNCT01000024.1; note = Pseudomonas benzenivorans
ccacctccacccgcaattaaataggttgttcaaatgcgacctgattcaaaaatgctataagcaactgccctacgctaatcctaatggttaacgtttggctacccttaagtctatagagtgaaatgcgggtgggggtttt

SEQ ID NO: 14819 - RNA, 141 nt, Pseudomonas fluorescens
  source 1..141: mol_type = other RNA; note = Related to NZ_CABVIZ010000005.1
tgtgctcccgcttgcgattaaactgggttgttcaaatgcgacccgattcagcaatgtagcaggctacagtcttgagttatatcttgagctgaatgttaagttatctatagtctatagggtgaagtgcaagcgggggcatct

SEQ ID NO: 14820 - RNA, 140 nt, Pseudomonas sp.
  source 1..140: mol_type = other RNA; note = Related to NZ_CP061723.1; note = Pseudomonas putida
atgcccctgcttgcgattaaactgggttgttaaaatgcgacccgattcaacaatgctgcaggctacagtccctgggttatctcaggtgctgaatgttaagttatctctagtctatagggtgaagtgcaagcgggggcatt

SEQ ID NO: 14821 - RNA, 140 nt, Pseudomonas sp.
  source 1..140: mol_type = other RNA; note = Related to LKBT01000034.1
cgccctcccctagttaaaatcagggttgttaaaatgcgacccaagtcaacaacgttacatgcgatcgcatcgacggttacgccaaagtggttgcgatttactcatcggtaatcggtaaagtaaactaggggcagggtctt

SEQ ID NO: 14822 - RNA, 140 nt, Pseudomonas sp.
  source 1..140: mol_type = other RNA; note = Related to NZ_AZQQ01000096.1; note = Pseudomonas mandelii
tttgctcgcccttagttaaactagggttgttaaaatgcgacccgagtcaaaaatgttacatgcgattgcctctacgtttactcaaagtggtagcaatttaattagcgctaatcggtaaagtaaactaagggcgagatcta

SEQ ID NO: 14823 - RNA, 147 nt, unidentified
  source 1..147: mol_type = other RNA; note = Related to RZHD01000010.1; note = Halomonas populi
tttggcctcctcttgggggtttatcttggcggagtcaaatgccgctgaatgccaataacgtctgctcaaatcgcagcgtccggtacgccattgagattgaaatgtaaattggtgatgcggaaagtgaaacccaagagaaggcctatg

SEQ ID NO: 14824 - RNA, 151 nt, unidentified
  source 1..151: mol_type = other RNA; note = Related to NZ_VCGW01000002.1; note = Marinobacter maritimus
tggcaacccggctcgtgattaatcttggcggttttaaatgctgcttaatgacaacgacgttaccacaaatcgcctctcagcacgttgctagcagcagctttgcaggcaaatttgagtaaagcgtaatgtgaaacttgagccgggcttttat

SEQ ID NO: 14825 - RNA, 139 nt, Cylindrospermum stagnale
  source 1..139: mol_type = other RNA; note = Related to NC_019757.1
tatcacttgcgggaataagtattgatttccgttgttgatcctgcgacggtgtatttgacggttagttttaacgacgcgcctagcgcgtttaattgcttttccttttccgagtaagcgagaatacacccgcgagtgatat

SEQ ID NO: 14826 - RNA, 144 nt, unidentified
  source 1..144: mol_type = other RNA; note = Related to LWHC01000033.1; note = Cyanobacterium sp. IPPAS B-1200
aatcacttgcgggataagttattgatttccattgttgatactgcgatggtgtattccaaggttagctttattacagtgtagtttcattgtaaattcatatattttatatatatgagtaaggtagaatacatccccaagtgattt

SEQ ID NO: 14827 - RNA, 141 nt, unidentified
  source 1..141: mol_type = other RNA; note = Related to NC_019779.1; note = Halothece sp.
agtcacttgcgggataagtattgatttccgttgttgatcctgcgacggtgtattttacggtcagctttacacaaccaatcgtggttttgttatttattggcttttcgcaagcataagcgagaatatacccgcaagtgatta

SEQ ID NO: 14828 - RNA, 155 nt, unidentified
  source 1..155: mol_type = other RNA; note = Cyanobacteria bacterium SW_9_44_58; note = Related to PXPI01000109.1
agtcacttgcgggataagtattgatttccgttgttgatcctgcgacggtgtattttactgttagctttacccgagtcgcgatcgtgtcgttcctttatatcatgcgttctatggctctctatgggaagaagttggaatgctcccgcaagtgattt

SEQ ID NO: 14829 - RNA, 158 nt, unidentified
  source 1..158: mol_type = other RNA; note = Related to RFIJ01001009.1; note = Bacteroidetes bacterium
agagatgcccggggtaggtattgatttccgttgttgatcctgcgacggttcaaaccaaggtttgctttatgcgactcccaggtctggggatggttgatgttcctagtttctggactcgacgccacgccataggtgagaatacacgccgggcatctctc

SEQ ID NO: 14830 - RNA, 130 nt, Microcoleus sp.
  source 1..130: mol_type = other RNA; note = Related to JACJPD010000044.1
ggatgtctatagagaaatattgattccgttgttgatcctgcgacggcgttatccaaagtcagctttacgctcgatcgaattaatccgattgcgatttgcagtaagcgagaatatattctgtagacatcct

SEQ ID NO: 14831 - RNA, 145 nt, Plectonema sp.
  source 1..145: mol_type = other RNA; note = Related to NZ_JADEWL010000096.1; note = Plectonema radiosum
ttggatactcgtttaaatgattgattcccgctgttgatcctgcggcggtatatttttgaaggtcaacgtatatacacgtgatcattcttttaattacttagcgattgctagggtagtaagttggaatatacagcgagtatccaat

SEQ ID NO: 14832 - RNA, 144 nt, unidentified
  source 1..144: mol_type = other RNA; note = Related to QBMH01000079.1; note = Leptolyngbya sp.
ttaggtactcgtacaaaattgattcccgctgttgatcctgcggcggtaatgttctaaggggtagcatatatatgccctcgtccagtgactttccctggtgccttccagtgcatagtaggttggaatatgttgcgagtatctaac

SEQ ID NO: 14833 - RNA, 144 nt, Pseudanabaena sp.
  source 1..144: mol_type = other RNA; note = Related to NZ_JAAVJL010000001.1; note = Pseudanabaena yagii
ctaggtattcgtgcaaaattgattcccgttgttgatcctgcgacggtaatgcatcaaggggtacgatatatacctcgttataacactgttacgcaaccttacgaactgttagtagtaagttagaatctggtacgagtacttagc

SEQ ID NO: 14834 - RNA, 150 nt, unidentified
  source 1..150: mol_type = other RNA; note = Related to JAIPEW010000016.1; note = Clostridiales bacterium
gtatgtggagtttgggaattgattttcgttgttgatcctgcgacgaatatggatggttaactttacgtgctttttcatatctttggtatgcctgtttcatgttacttggctcagagatgcagtaagcagaattccaaactccatcatata

SEQ ID NO: 14835 - RNA, 161 nt, unidentified
  source 1..161: mol_type = other RNA; note = Related to JACDEG010000211.1; note = Pyrinomonadaceae bacterium
tcgggcgtttgcggaccctattgactccctgccgttgttactgcggcagatacgacaagggtagcctgatagctgccggtgatcgttcattgttcagcctcaatgctactcacagctttaccgtggaggcagtaagcagaataagttcgcggacgcccgcc

SEQ ID NO: 14836 - RNA, 149 nt, unidentified
  source 1..149: mol_type = other RNA; note = Related to MSXN01000018.1; note = Nitrospira sp.
gttgggcttgcgggatgtattgaagtctgttgttgatcctgcgacaggtcaaatcaaggggccatatatgcctcttgtgctttacgtgtatagcttacagtgtttacctcttgttcttggcagaaggcggaatacccgcaagccctcct

SEQ ID NO: 14837 - RNA, 141 nt, unidentified
  source 1..141: mol_type = other RNA; note = Parcubacteria group bacterium; note = Related to JACPLU010000002.1
aaaagggtgtgataacaattgattgccgttgtgtttcgcgacggatgagaaacggttccttttacttgctttatgtgcgtaatgttatggatatagacattaccgtgcttgcagaaagagaatttaaatcgcacccttttt

SEQ ID NO: 14838 - RNA, 149 nt, unidentified
  source 1..149: mol_type = other RNA; note = Related to DOHN01000106.1; note = Ruminiclostridium sp.
gtatatgggagtaaagtaattgatttttcgttgttgatcctgcgacgataatggaatggttagggcaacgtgccttactattatttatttacttcatctttattcctagctgctcctcggcaataagtagaattatactcccatatact

SEQ ID NO: 14839 - RNA, 147 nt, unidentified
  source 1..147: mol_type = other RNA; note = Lachnospiraceae bacterium; note = Related to JAFQLB010000113.1
aaacataggagaatttattttcgttagtgttaccgcaacgatgtatgacgatgttaggcagagatccgttctctgtttactcctctgtttagaaaacaatcagaatttattctgaatgttggataaggtagaattctcctatttttt

SEQ ID NO: 14840 - RNA, 145 nt, unidentified
  source 1..145: mol_type = other RNA; note = Gammaproteobacteria bacterium; note = Related to JAKITL010000008.1
ttgagcctccctcttctatatttgccgtcgatactgcggtagagaaatcaataccctcctttacgcatcctcggctactgggtgtcaatgtggctgaatatgcgattgcgttatcctgcgtaaagtgcgaggagggaggctcact

SEQ ID NO: 14841 - RNA, 157 nt, Nitrosomonas sp.
  source 1..157: mol_type = other RNA; note = Related to FOSP01000012.1
gggtgcgtccttcttctatatttgctgttgatcctgcggcagaaaaacacgatgtttcccattatgctcatttactcgttgtagtggtactgagcttattgttacttttagtatttatcttgcgtatttgcgtaaggtgcgaggaaggatgcgctca

SEQ ID NO: 14842 - RNA, 138 nt, unidentified
  source 1..138: mol_type = other RNA; note = Related to JABIUT010001148.1; note = Candidatus Scalindua sp.
aatgcccccactctctaaatttgctgttgatcctgcggcagaaaacagcgtagttatttcttacgactgtgttacgttatgttatgattgttattactttagtgttgccttgtataaagaatgagggtgggggtgttc

SEQ ID NO: 14843 - RNA, 153 nt, unidentified
  source 1..153: mol_type = other RNA; note = Planctomycetes bacterium; note = Related to CP066225.1
ataagcccctagatcttcagtatggccgtcgatcccgcggctacccattgtaatgttcttctatatgcgttacgacgatcatcaatattcgctacgtcattatgttgtgtcgttgcgtcgttggcaaaaggaaagatgatctaggggcttttt

SEQ ID NO: 14844 - RNA, 164 nt, unidentified
  source 1..164: mol_type = other RNA; note = Campylobacteraceae bacterium; note = Related to JAFLKZ010000048.1
caagagatactttatacattctatatttgctgtgcacctgcggcagacaacaaaattgtttctaattaagcttaccttatgagtttctgattgtgatgcttagtgtcctaacttgtacgctttgaatcgcataataaaagtgtgattgataaagtatctctcta

SEQ ID NO: 14845 - RNA, 152 nt, unidentified
  source 1..152: mol_type = other RNA; note = Related to MIBX01000109.1; note = Sulfurimonas sp.
acgggatgctttacgtattctatatttgctgttgttcctgcggcagacaacaaaaatgttctttattaatagattgtgaactcttaaaaatctgttaacttatctttatatactagtttgattataaagtgcgattagtgaagcatcccaat

SEQ ID NO: 14846 - RNA, 151 nt, unidentified
  source 1..151: mol_type = other RNA; note = Related to JAGBOM010000008.1; note = Opitutales bacterium
aaatgcttcccctttctatcttccgaggcgttcctgcttcgttatattcaaagttcttccttatggtatatcgattgattactattgttgaataatattacaatattatctatcgtccaatctatataaagagcgaaaggggaagcacctc

SEQ ID NO: 14847 - RNA, 141 nt, unidentified
  source 1..141: mol_type = other RNA; note = Related to NZ_BEWN01000005.1; note = Gluconobacter frateurii
aggcttacaggcagaattgttgtccggcttcgagacatatgtaccaatgttaggagagctcttgtgcttccctgatacttattgcggtttgtctgttttaatcagatcgcccattgttcgcgtaggagtgcctgtaagctt

SEQ ID NO: 14848 - RNA, 141 nt, unidentified
  source 1..141: mol_type = other RNA; note = Related to SAQI01000010.1; note = Mesorhizobium sp.
aggcttacaggcagatttgttgtccggcttcgagacatatgtaccaatgtcaggaggtctcttgtgcttccttgacacttattgcgggttatccgtttcgttcagattgcccgatattcgcgtaggagtgcctgtaagcct

SEQ ID NO: 14849 - RNA, 148 nt, unidentified
  source 1..148: mol_type = other RNA; note = Related to CP060244.1; note = Entomobacter blattae
cggcttacaggcagaattgttgtccggattcgagacatatgtaccaatgccaagctacgcttgtgcttctttaacacttattgcgggttaaacatttcgtttgtttaaatagcccgtatgttcatcgcgtaggagtgcctgtaagcct

SEQ ID NO: 14850 - RNA, 141 nt, unidentified
  source 1..141: mol_type = other RNA; note = Related to JAGHQS010000002.1; note = Qipengyuania flava
aggcttacaggcagaattgttgtccggattcgagacatatgtaccaatgccaggagggcacttgtgctcccttgacacttattgcggtttgaacattttgttcaagttgcccgatgattgcgtaggagtgcctgtaagcct

SEQ ID NO: 14851 - RNA, 140 nt, unidentified
  source 1..140: mol_type = other RNA; note = Related to JAINWB010000007.1; note = Thalassospira xiamenensis
tggcttacaggcagaattgttgtccggtttcgagacatatgtaccaatttcaggagggcttttgtgcttcctggatacttattgcgggctattcgtgtgtttagattactcgatgtacgcgtaggagtgcctgtaagcct

SEQ ID NO: 14852 - RNA, 141 nt, unidentified
  source 1..141: mol_type = other RNA; note = Alphaproteobacteria bacterium; note = Related to JADGDA010000026.1
aggcttacaggcagaattgttgtccggatttcgagacatatgtaccaatgctggggagaggtttgtgctcccttgacacttattgcccgagctgtttgtgatctatgggctgaatgttcgcgtgggagtgcctgtaagccc

SEQ ID NO: 14853 - RNA, 146 nt, unidentified
  source 1..146: mol_type = other RNA; note = Related to NZ_QAYR01000012.1; note = Rhizobium pusense
aggcttacaggcagaattgttgtccggtttcgagacatatgtaccaatgcaaggggagtgtttgtgcttcctacgtttccaatgcctgcatgatttctatgggattacgccggcttataccttcgcgtaagagtgcctgtaagccg

SEQ ID NO: 14854 - RNA, 147 nt, unidentified
  source 1..147: mol_type = other RNA; note = Related to JADOUL010000002.1; note = Labrenzia sp.
aggcttacaggcagaattgttgtcttgcttcgaggcatatgtatcaaggtcaggagagcggttgtgcttcctgatgcctattatggccttatcggtatcgtgaatattgatcaatgagccaattcgcataagagtgcctgtaagcct

SEQ ID NO: 14855 - RNA, 142 nt, unidentified
  source 1..142: mol_type = other RNA; note = Related to NZ_JACICD010000010.1; note = Angulomicrobium tetraedrale
tggcttacgggcagaattgttgtccggtttcgagacatatgtaccaatgccaggggagcgcttgtgctaccatggaacgtattgccgatttgggcggaatggcttgtcggcgtgacgatcgcgtaagagtgcccgtaagcct

SEQ ID NO: 14856 - RNA, 138 nt, unidentified
  source 1..138: mol_type = other RNA; note = Related to NCFD01000067.1; note = Acidocella sp.
aagtttacaggcagaattgttgtccggtttcgagacatatgtaccaatgtcagatggacgtttgtgctacctgatgttcttattgcacaatgtatatcttattatactatgtgatcgcgtaggagtgcctgtaagctt

SEQ ID NO: 14857 - RNA, 139 nt, unidentified
  source 1..139: mol_type = other RNA; note = Related to JAFKKU010000016.1; note = Hyphomicrobiales bacterium
cagcttgcgggcagatttgttgtccggattcgagacatatgtgaccatgccaggaaagcgcttgtgctaccctgcgtcttaatgcttggcatctataaatcgaggtgcttggcgtacgcgtaagagtgcccgcaagctt

SEQ ID NO: 14858 - RNA, 143 nt, unidentified
  source 1..143: mol_type = other RNA; note = Rhodospirillales bacterium; note = Related to JACKIO010000012.1
ggacttgcaggcagacttgttgtccgggttcgagacatatgaagaaacgtcaggagggcatttgtgcttccctgatgcttattgcggtccgattatatgcaatgtttaacgcaccgtgatcgcgtaggagtgcctgcaagtcc

SEQ ID NO: 14859 - RNA, 138 nt, unidentified
  source 1..138: mol_type = other RNA; note = Proteobacteria bacterium; note = Related to JABGZD010000203.1
ggacttgcaggcagacttgttgtccgggttcgagacatatgatgcaatgtcaggagagcgcttgtgcttccccgatacttattgcggtatgaatgaacgaatgattcgccgtaatcgcgtaggagtgcctgcaagtcc

SEQ ID NO: 14860 - RNA, 145 nt, unidentified
  source 1..145: mol_type = other RNA; note = Gammaproteobacteria bacterium; note = Related to VYFW01000066.1
ggacttgcaggtagatttgttgtccgggttcgagacatatgattcaatgtcaggaaagcgcttttgctgccctgattcctattccgactttactcgtcaagagttttgtcgaactgcgtgattgcgtaggagtgcctgcaagtcc

SEQ ID NO: 14861 - RNA, 144 nt, unidentified
  source 1..144: mol_type = other RNA; note = Related to NZ_QWGA01000003.1; note = Henriciella algicola
gagcttgcgggtagatttgttgtccggattcgagacatatgaagaaatgcgggggaacatctgtgcttccctgaaccatactgcggcatactgtgtgctgtgttacggtgatcgtcgtgatcgcgtatgagtgcccgcaagcct

SEQ ID NO: 14862 - RNA, 140 nt, unidentified
  source 1..140: mol_type = other RNA; note = Related to NZ_BARJ01000009.1; note = Gluconobacter oxydans
tgacttgtaggtagacttgttgtccggtttcgagacatatgaaccaacgtcaggagtgcacttgtgcttccctgagacttattgcggttaatacgatttaatctatattctccgtttcgcgtaggagtacctacaagtca

SEQ ID NO: 14863 - RNA, 144 nt, unidentified
  source 1..144: mol_type = other RNA; note = Related to NWSX01000001.1; note = Rhizobium sp.
gggcttgcaggcagacttgttgtccggattcgagacataagattcaacgctagggggcctcttgtgcttccctggtccatattgcggttactggacctgcctattggttcatcgccgtgctcgcgtaagagtgcctgcaagtcc

SEQ ID NO: 14864 - RNA, 130 nt, unidentified
  source 1..130: mol_type = other RNA; note = Related to NZ_LT670818.1; note = Bradyrhizobium erythrophlei
aagcttacaggcagatttattatcgtgtttcgcgatatatgatccaaagtcaggcacgctgctccctatgatccatgattgaaacatatggcccatggcctatgcgacgcgtaggagtgcctgtaagcct

SEQ ID NO: 14865 - RNA, 128 nt, unidentified
  source 1..128: mol_type = other RNA; note = Related to JADPKY010000194.1; note = Bradyrhizobium sp.
aagcttacaggcagatttgttatcgtgtttcgcggtatatgaaccaatgtcagggacgctgctccctatacgatcctcgatgcatatggccaatggcccatgcgacgcgtaggagtgcctgtaagccc

SEQ ID NO: 14866 - RNA, 130 nt, unidentified
  source 1..130: mol_type = other RNA; note = Related to JACIHF010000027.1; note = Bradyrhizobium sp.
aagcttacaggcagattcgttgtcgtgtttcgcgatatatgattcgatgtcagggacgctgctccctgtgatccgtatgatatgtttcggcctatggcctgcgcgctcgcgtaggagtgcctgtaagcct

SEQ ID NO: 14867 - RNA, 130 nt, unidentified
  source 1..130: mol_type = other RNA; note = Related to FOUS01000020.1; note = Bradyrhizobium sp.
aagcttacaggcagatttgttatcgtgtttcgcgatatatgatccaacggcaggagcgctgctcctgagcgatgctcaatgatctccaggtatgatggcctgcgcggcgcgtaggagtgcctgtaagcca

SEQ ID NO: 14868 - RNA, 128 nt, unidentified
  source 1..128: mol_type = other RNA; note = Related to NZ_FYEH01000004.1; note = Arboricoccus pini
aagcttacaggcagatttgttatcgtgtttcgcgatatatgatccaatgtctcggacgctgctccctacaggctgctctatgtcagcatgatgtgatgcacacttcgcgtaggagtgcctgtaagcct

SEQ ID NO: 14869 - RNA, 132 nt, unidentified
  source 1..132: mol_type = other RNA; note = Related to NZ_AXAP01000106.1; note = Bradyrhizobium elkanii
aggcttacaggcagatttgttatcgtgcttcgcgatatatgattcaatgtccccggatgctgctccgagacgacgagctcgatgagtgcatggcgaaccacccatgcggcgcataagagtgcctgtaagcct

SEQ ID NO: 14870 - RNA, 132 nt, unidentified
  source 1..132: mol_type = other RNA; note = Related to JAFCMB010000001.1; note = Bradyrhizobium sp.
aggcttacaggcagacttgttgtctcgttattgaggcatatgaaccaatgttgagggctgtcgctcctcgacgctcctggacggcgcgctggtataattgcacgtcgtacgcataagagtgcctgtaagctc

SEQ ID NO: 14871 - RNA, 132 nt, unidentified
  source 1..132: mol_type = other RNA; note = Related to MEEX01000061.1; note = Phenylobacterium sp.
aggcttgcagacagacttgttgtctcgttattgaggcataagaaacaatgttggggacggtcgctcctcgacgctccttcagggacgcatcgtcgatgggccatgcgcacgcgtaagagtgtctgcaagccc

SEQ ID NO: 14872 - RNA, 126 nt, unidentified
  source 1..126: mol_type = other RNA; note = Related to NZ_JAENJN010000015.1; note = Brevundimonas diminuta
aggcccacaggcagacttgttgtcgcgttattgcggcatatgaaacaacgtcagggcgtcagccctatgacgctatacgcgccgatgcgattggtgctgatcatgcgtaggagtgcctgtgggccg

SEQ ID NO: 14873 - RNA, 143 nt, unidentified
  source 1..143: mol_type = other RNA; note = Related to NZ_CP054836.1; note = Oricola thermophila
ccgcttacaggcagaattgttatcgcgtatcgcgatataagaaacaatgtcaggagggaatcgcttcccgacgatccttaatgcctattcgtttgtgatgaatggacgaaaactgggtatcgcataggagtgcctgtaagcat

SEQ ID NO: 14874 - RNA, 139 nt, unidentified
  source 1..139: mol_type = other RNA; note = Rhodospirillaceae bacterium; note = Related to PBKC01000100.1
gggcttacaggcagatttgttatcgcgtttcgcgatatatgacttgctgtcaggaggcgttgcttcccgacgatccttaatgcgcgttcaatcgatacgatgcgatgcgcatggtacgcttaagagtgcctgtaagcct

SEQ ID NO: 14875 - RNA, 135 nt, unidentified
  source 1..135: mol_type = other RNA; note = Related to NZ_JAGHQP010000025.1; note = Brevundimonas sp.
tggcttacaggcagatttatcgtcgagtttcgcgacgtatgaagcaatacgacttgtcgttgcttcctaataacccttaatctatttgcccatatgcgggcgactggatgatcgcataggagtgcctgtaagcct

SEQ ID NO: 14876 - RNA, 141 nt, unidentified
  source 1..141: mol_type = other RNA; note = Related to NZ_LT960614.1; note = Hartmannibacter diazotrophicus
cggcttacaggcagatttgtcgtcgtgtttcgcgacgtatgaagcaatactacttagagttgcttccctatgaacccttattgctatttgaccacttaatggcaaatgcacttgcgatcgcataggagtgcctgtaagccc

SEQ ID NO: 14877 - RNA, 139 nt, unidentified
  source 1..139: mol_type = other RNA; note = Related to NZ_PSRS01000004.1; note = Bradyrhizobium sp.
gagcttacaggcagatttattgttgcgctatcgcaacataagaccgaaggtcagaggccaatgcttcctgactgcagaattatgcacgttcaatgcggaatacgaaatcgcatgatcgctaaggagtgcctgtaagctc

SEQ ID NO: 14878 - RNA, 135 nt, unidentified
  source 1..135: mol_type = other RNA; note = Related to NZ_CP085136.1; note = Lichenihabitans sp.
aggcttacaggcagacttgttatcacgtctcgtgatatatgaaccaatgtgacccaatgtttgctcaccgaggggcgatacgatcgatcaatcgatgggcgatccgtgcctacgcgtaggagtgcctgtaagccg

SEQ ID NO: 14879 - RNA, 135 nt, unidentified
  source 1..135: mol_type = other RNA; note = Related to NZ_LABZ01000002.1; note = Methylobacterium tarhaniae
cggcttacaggcagatttgttatcgcgtatcgcgatatatgaaacaatgtcaggcggcgtttgctctccgactgacgatcatggatatgggacattatgggctgatggcctacgcataggagtgcctgtaagccg

SEQ ID NO: 14880 - RNA, 143 nt, unidentified
  source 1..143: mol_type = other RNA; note = Related to SDGU01000027.1; note = Chlorobaculum sp.
ttgcttacaggcagatttgttgttgtgcttcgcaacataattatagacgtaagggggttttgctccttttcgtatccttattgcacggcgttcaatgttcgctgtcagttgttctgaggtcgcataggagtgcctgtaagcaa

SEQ ID NO: 14881 - RNA, 136 nt, unidentified
  source 1..136: mol_type = other RNA; note = Related to NZ_LNYU01000023.1; note = Legionella santicrucis
aagcttatgaacagatttgctatcgtgtttcgcgatatattcatccaatgttggatgctttgctttcattacgcttttaaagcagcagcaattagtaaatatacactagttatcgcataagagtgttcataagcta

SEQ ID NO: 14882 - RNA, 137 nt, unidentified
  source 1..137: mol_type = other RNA; note = Related to NZ_CP014691.1; note = Neoasaia chiangmaiensis
aggcttacaggcagagttgttatcgcgtatcgcgatataagacatcgatgttgggcagtgatgcttccaactacccttattgcagctgcaaagctgagcggacgatcgatcggtcgcataggagtgcctgtaagccg

SEQ ID NO: 14883 - RNA, 138 nt, unidentified
  source 1..138: mol_type = other RNA; note = Related to AP018498.1; note = Altererythrobacter sp.
aggcttacaggcagagttgttatcgcgcatcgcgatataagacaccgatgttaggcagtgatgcttccatctacccttattgcagcatttccgctgagcggacgatctgatcgtacgcataggagtgcctgtaagccg

SEQ ID NO: 14884 - RNA, 138 nt, unidentified
  source 1..138: mol_type = other RNA; note = Related to NZ_NISJ01000021.1; note = Sphingopyxis witflariensis
aggcttacaggcagagttgttatcgcgcatcgcgatataagacaccgatgttaggcagtgatgcttccatctacccttattgcagctttacggctgagcggacgatccgatcgaacgcataggagtgcctgtaagccg

SEQ ID NO: 14885 - RNA, 139 nt, unidentified
  source 1..139: mol_type = other RNA; note = Related to NZ_CP046252.1; note = Sphingobium sp.
aggcttacaggcagagttgttatcgagaatcgcgatataagacaccgatgttgggcagtgatgctctccatctacccctaatgcagctttaccgctgagcggacgatctgatcgaacgcataggagtgcctgtaagcca

SEQ ID NO: 14886 - RNA, 138 nt, unidentified
  source 1..138: mol_type = other RNA; note = Related to JAACTB010000013.1; note = Erythrobacter sp.
cggcttacaggcagagttattatcgcgcatcgcgatatacgacaacgatgttgggcagcgatgctcccattgagaaactttgtgtaactgaccgttatagaacgttcgtgacgaacgcataggagtgcctgtaagcca

SEQ ID NO: 14887 - RNA, 140 nt, unidentified
  source 1..140: mol_type = other RNA; note = Related to CP030050.1; note = Bradyrhizobium arachidis
gggcttacgggcagagttgttatcgcgcatcgcgatataagacaaagatgccaaatctcgattgcttcctgagcaatcgtaatgcgacgagtgtttgaccagtgaatgctcggtgatcgcataggagtgcctgtaagccc

SEQ ID NO: 14888 - RNA, 141 nt, unidentified
  source 1..141: mol_type = other RNA; note = Related to JAKSYA010000167.1; note = Methylobacterium sp.
tggcttgcaggtagagttgttatcgcgtatcgcgatataagataaggatgttaggaggcgattgcttcccgtattccattattgcgctttcatgatggtccattatgggtcgtcatctcgcatatgagtacctgcaagctt

SEQ ID NO: 14889 - RNA, 140 nt, unidentified
  source 1..140: mol_type = other RNA; note = Related to NZ_FOTK01000017.1; note = Methylobacterium pseudosasicola
aagcttgcaggcagagttgttatcgcgcatcgcgatataagctaagaatgtcaggaggcgattgcttcccatgaccccttattgcagatctatgatccgcatcactgacgaccataccgcataagagtgcctgcaagctt

SEQ ID NO: 14890 - RNA, 142 nt, unidentified
  source 1..142: mol_type = other RNA; note = Related to NZ_VDDA01000005.1; note = Methylobacterium terricola
aagcttgcaggcagagttgttatcgcgccatcgcgatataagagaacgatgccgggaggtgattgcttcctatggcgtcttaatgcataaaaatgatcagacggtatgagcgatcgtatcgcataggagtgcctgcaagccc

SEQ ID NO: 14891 - RNA, 144 nt, unidentified
  source 1..144: mol_type = other RNA; note = Related to JAGWBW010000022.1; note = Candidatus Latescibacteria bacterium
tggcttacaggcagaactgtatcgcgtatcgcgataaaagataaaatgttaggatgtgttgttgcttcgtccaattctttaatgcggcattttcgttgttgttgtgtttgtgtgtgtgtttcgcataggagtgcctgtaagccg

SEQ ID NO: 14892 - RNA, 144 nt, unidentified
  source 1..144: mol_type = other RNA; note = Related to VXMB01000009.1; note = Gemmatimonadetes bacterium
cggcttacaggcagaatgctatcgcgcatcgcgatacaagacgaaacggtgggatgtgagtacgccgcttttcctttctgcgattcaatgtctgtctgttgcattgatcggatcggcagttcgcgtaggagtgcctgtaagcca

SEQ ID NO: 14893 - RNA, 142 nt, unidentified
  source 1..142: mol_type = other RNA; note = Related to JAIPDZ010000080.1; note = Deltaproteobacteria bacterium
tggcccatggacagatttattattgtgtatcgcaatataagaaaccaatgtcagggcggattgcttcctggctatcctttttgcagtgtattttatgtcccagtatactgtgttactctcgcataagagtgtccatgggcca

SEQ ID NO: 14894 - RNA, 141 nt, unidentified
  source 1..141: mol_type = other RNA; note = Bacteroidales bacterium; note = Related to JAGGXD010000009.1
tggctcatggatagatttgttattgtgtatcgcaatatacgaaaccaaagtcaggatggattgcttcctggttatcctttatgcagtatatctgaatgtccactgtatactgtattatcgcataagagtgtccatgagcca

SEQ ID NO: 14895 - RNA, 144 nt, unidentified
  source 1..144: mol_type = other RNA; note = Related to JAKISH010000034.1; note = Gammaproteobacteria bacterium
tgactcatggatagatttattattgtgtatcgcaatataagaaactaatgtcaggatggatttgcttcctgataatcctttacgcagtgtgccagtatgacttggttacagtgttacatatcgcataagagtatccatgagtca

SEQ ID NO: 14896 - RNA, 144 nt, unidentified
  source 1..144: mol_type = other RNA; note = Related to JAFDMD010000032.1; note = Deltaproteobacteria bacterium
tggctcatagtcagatttattattgcgcatcgcaatataagaaataatgccaggttgtgttacttcctgacaatcattcgttgctattggttatgttataatatagttatattacatttctcgcataggagtgtctatgagccg

SEQ ID NO: 14897 - RNA, 126 nt, unidentified
  source 1..126: mol_type = other RNA; note = Related to JAGQKD010000345.1; note = Nitrospira sp.
gggtctataggcagatttgttattgcgtatcgcagtataagaaaccaatgtcgggaggcttgcttcctcgactcccttgtagcacttggctaggtgtcacctgtgcaaaagagtgcctatagaccc

SEQ ID NO: 14898 - RNA, 146 nt, unidentified
  source 1..146: mol_type = other RNA; note = Syntrophaceae bacterium; note = Related to JAGNKF010000015.1
aggcttataggcagatttattgttgtgaatcgcaaccataagaaaccaatgtcaccggggttcgcttacccagtatactattggctacgtatctttagatgtgtatgcatatagctaccttctcgcaaaagagtgcctataagcct

SEQ ID NO: 14899 - RNA, 148 nt, unidentified
  source 1..148: mol_type = other RNA; note = Related to NZ_CP087999.1; note = Geomonas sp.
cggcttgtaggcagatttgttattgtgaatcgcaatataagaaaccaaagtcagggagtgttgcttcccacagacgtaccgcactttggctactagcattatgactttacgttacttgacgttatcgcttaagagtgcctacgagccg

SEQ ID NO: 14900 - RNA, 126 nt, unidentified
  source 1..126: mol_type = other RNA; note = Related to NZ_FNJI01000013.1; note = Desulforhopalus singaporensis
tgacttataggtagatttgttattgtgtttcgcaattatatgaaaacaaaggtaggtagacttgcctccctgatccttcgcttatcctgtgagatcctgatctcgcataagagttcctataagtca

SEQ ID NO: 14901 - RNA, 142 nt, unidentified
  source 1..142: mol_type = other RNA; note = Related to DNTK01000207.1; note = Bacteroidales bacterium
tggctcataaacagatttgttattgtgtttcgcaatatatgaaactaatgtttagactcattagtgcttattaatctttatgcttattaatatttataatgtttttaagcttttctagacgcataggagtgtttatgagcct

SEQ ID NO: 14902 - RNA, 135 nt, unidentified
  source 1..135: mol_type = other RNA; note = Related to BLXY01000001.1; note = Geomonas paludis
cggcttataggcagatttattgatgcgtttcgcattcataagaaaccaatgttacgttggcagttgttgcttttcggtgtcccatagtattacgtactgttcgcctattactcgcataagagtgcctataagccg

SEQ ID NO: 14903 - RNA, 140 nt, unidentified
  source 1..140: mol_type = other RNA; note = Related to NZ_LVJN01000020.1; note = Proposed Magnetofaba australis
aggcttacaggcagacttgttatcatgtttcgtgatatacgtaaccaatgttaggtaggctttgctccctaacgttccttctgtcagcttggcgtttcgctatgctgtgcaacgttccgcataggagtgcctgtaagcct

SEQ ID NO: 14904 - RNA, 141 nt, unidentified
  source 1..141: mol_type = other RNA; note = Rhodospirillales bacterium; note = Related to CP064988.1
gggcttgcaagcagatttgttgtcgtgtctcgcgacataagatcgaacgtcagaggggattgctccccaggatgctcgaagcgcgcatagcgtcacgtaacggatagcctagcggtttcgcgtaagagtgcttgcaagccc

SEQ ID NO: 14905 - RNA, 147 nt, unidentified
  source 1..147: mol_type = other RNA; note = Related to JAKSYD010000289.1; note = Methylobacterium sp.
cggcttgcgggcagatttgttgtcgcgaatcgcggcataagacaacgatgtcagggggtacttgctcccaggcaacgatcctagaagagcatactcgatgacgcctaaagtaaatccgcggcgttgcataggagtgcccgcaagctt

SEQ ID NO: 14906 - RNA, 141 nt, unidentified
  source 1..141: mol_type = other RNA; note = Related to JAGQAF010000003.1; note = Ruegeria pomeroyi
gggcttacgggcagacttcctgctgcgcatcgcggcaaatgacaacaatggtaggcaggctgcttaccttcaggttcccttgcggtatcttccggttttccggtgtatcgccgacgctcgcataagagtgcccgtaagcac

SEQ ID NO: 14907 - RNA, 136 nt, unidentified
  source 1..136: mol_type = other RNA; note = Related to JAGIOQ010000002.1; note = Rhizobium leguminosarum
cagcttacgggcagacttcctgctgcgtatcgcggcaaatgacgacaatggtagccgtgctgctacctcaggttccttgcggtacttcggattatttgagtatcgcctacgctcgcataagagtgcccgtaagcat

SEQ ID NO: 14908 - RNA, 141 nt, unidentified
  source 1..141: mol_type = other RNA; note = Related to NZ_LZYE01000077.1; note = Acidithiobacillus caldus
tgccttacgggcagacttccggctgcgcatcgcggcaaatgacaacaatggtaggcgtgctgcttacgtctaacttcttttgcgatatttggagttctctatcatgtatcgcttactttcgcttaagagtgcccgtaagca

SEQ ID NO: 14909 - RNA, 140 nt, unidentified
  source 1..140: mol_type = other RNA; note = Related to NZ_SDEA01000026.1; note = Paracoccus luteus
atgcttacgggcagacttcctgccgcgcatcgcggcaaatgataacaatggtaggcaggctgcttaccttcaggttcccttgcggtgtttccggttttccggtgtatcgccgacgctcgcataagagtgcccgtaagcac

SEQ ID NO: 14910 - RNA, 145 nt, unidentified
  source 1..145: mol_type = other RNA; note = Related to JAGHRJ010000002.1; note = Labrenzia sp.
ttgcttacgggcagacttactgctgcgtatcgcggcaaatgacaacaacggtaggcagtctgctgtccatcggtctttctttgcgatttcatatggttatcctattgaaatcctgcaacttcgctcaaggagtgcccgtaagcgc

SEQ ID NO: 14911 - RNA, 143 nt, unidentified
  source 1..143: mol_type = other RNA; note = Related to NZ_JAAXDY010000025.1; note = Rhizobium leguminosarum
gtgcttacgggcagaattactactgcgcatcgcggtaaatgacaacaatggtaggcaggctgctgctcacctacggtcccttttgcatggccacggacaatatgatcgatgagccatcgacgcataggagtgcccgtaagcac

SEQ ID NO: 14912 - RNA, 143 nt, unidentified
  source 1..143: mol_type = other RNA; note = Related to JAHJTN010000036.1; note = Bacteroidetes bacterium
tggcttacgggcagacttcctgctgcgaatcgcggcaaatgacaaaaatggtaggcaggctgctgaccgaccatgatccctttgcaatcgttcggttatacctgatgattgacctgagatcgcgtaagagtgcccgtaagctc

SEQ ID NO: 14913 - RNA, 148 nt, unidentified
  source 1..148: mol_type = other RNA; note = Related to JAGRRC010000006.1; note = Ciceribacter sp.
gagcttgcggacagatttaatgtcgcgcatcgcgacatatgatccgaatggttggcactctgctttccatcagatttcttttgcggattttcgagttttcgaattttcgtatttgcttaccacatcgcataagagtgtccgcaagcta

SEQ ID NO: 14914 - RNA, 142 nt, unidentified
  source 1..142: mol_type = other RNA; note = Mycobacteriaceae bacterium; note = Related to JAIERP010000170.1
gagcttacgggcagaattggtgccgcgtttcgcggcatatgacaacaatggtaggcacgctgcttcccatatgaaaatctttgcggactttccgttcatctggaaaattcgctacacatcgcaaaagagtgcccgtaagctc

SEQ ID NO: 14915 - RNA, 135 nt, unidentified
  source 1..135: mol_type = other RNA; note = Related to NZ_ML660062.1; note = Denitrobaculum tricleocarpae
gagcttgcgggcagaattactgccgcgcaatcgcggcaaatgacaacaatggtaggcatgctgctttccgtccatgatccctttgcgaatatctatgaatattcggtcgtctcgcataagagtgcccgcaagctc

SEQ ID NO: 14916 - RNA, 141 nt, unidentified
  source 1..141: mol_type = other RNA; note = Related to JACKJA010000002.1; note = Rhodospirillales bacterium
aggcttgcgggcagacttcttgctgcgcatcgcggcaaatgacaacaacggtaggtgggctgctcatcaccgtgatccttttgcggacagtcctcatggaccatgtctcgccgattatcgcttaagagtgcccgcaagcct

SEQ ID NO: 14917 - RNA, 132 nt, unidentified
  source 1..132: mol_type = other RNA; note = Related to NC_013440.1; note = Haliangium ochraceum
aagcttacgggtagactttctgctgcgcatcgcggcaaatgaaaacaatggtagggcatgatgctctccgttgcatgtatctttgcggatctttattcgacattacagtcgcctaggagtacccgtaagcgt

SEQ ID NO: 14918 - RNA, 124 nt, unidentified
  source 1..124: mol_type = other RNA; note = Related to NZ_MZXU01000017.1; note = Bosea sp.
gtgcttacgggcagacttcctgctgcgtatcgcggcaaatgacaacaatgttaagcgggctgcttcccgttatagatcctttgcagatatctgccatagatcgcataagagtgcccgtaagcaa

SEQ ID NO: 14919 - RNA, 131 nt, unidentified
  source 1..131: mol_type = other RNA; note = Gammaproteobacteria bacterium; note = Related to PDSV01000021.1
gggcttacgggcagaattattatcgcgtatcgcgataagtgacaacaatactagaacctagtgcttaaaggtatcttaaaggacgaaaggaattaaaggattcgtcttcgcgtaagagtgtccgtaggcct

SEQ ID NO: 14920 - RNA, 121 nt, unidentified
  source 1..121: mol_type = other RNA; note = Related to JAFECG010000019.1; note = Proteobacteria bacterium
aagcttgtgagcagatttatgatcgcgtttcgcgatctatgacagaaatgtccagagtactgcctctacgctacaactctttatcgctcgcaacctcacgcagaggagtgctcacaagctt

SEQ ID NO: 14921 - RNA, 127 nt, unidentified
  source 1..127: mol_type = other RNA; note = Alphaproteobacteria bacterium BRH_c36; note = Related to LOEV01000045.1
aagcttgtgggcagacttatgatcgcgtttcgtcgatctatgacaacaatgttgggggcactgccctaatcggtgcttccttagtgcaactcggaaaacctcatcgcagaggagtgcccacaagctc

SEQ ID NO: 14922 - RNA, 153 nt, unidentified
  source 1..153: mol_type = other RNA; note = Related to PAIP01000075.1; note = Parvularcula sp.
gaacccacaggcagacttatcgtcgcgaatcgcggcgtatgaaaacaatgttggcgacgctgctcccaacgccatcccagtgctgtacagtgttgtccagcgttatcatggactgcacatctatgcgtatcgcaaaggagtgcctgtgggttt

SEQ ID NO: 14923 - RNA, 145 nt, unidentified
  source 1..145: mol_type = other RNA; note = Related to WVQY01000005.1; note = Ruegeria atlantica
gagcttgtgggcagaattatcgttgcgctatcgcgacgtgtgagatgaaacagcaggtgctgctatcatcaagacactttatgcattcgtagactattcgatgcaggctgatccgatgagatcgcataagagtgcccacaagctc

SEQ ID NO: 14924 - RNA, 131 nt, unidentified
  source 1..131: mol_type = other RNA; note = Related to NZ_FOSL01000011.1; note = Mesorhizobium albiziae
gggcttgcggatagattctgctgttgttgtttcggcgatagttgatatcaatgcacggcttactgcccgaccattccttacggactgtcctatgtggtccgacgccttggcgaacgagtatccgcaagccc

SEQ ID NO: 14925 - RNA, 131 nt, unidentified
  source 1..131: mol_type = other RNA; note = Related to JAHRFK010000006.1; note = Hoeflea sp.
tggcttgcggatagattctgctgttgttgtttcggcgatagttgatatcaatgcagggcttactgcccgaccattccttacggactgtccaatgttgtccgacgcttttgcaaacgagtatccgcaagcca

SEQ ID NO: 14926 - RNA, 130 nt, unidentified
  source 1..130: mol_type = other RNA; note = Related to JAIUHW010000003.1; note = Mesorhizobium sp.
tagcttgcggatagattctgctgttgttgtttcggcgatagttgatatcaatgcagggcttactgcctgaccattccttacggactgaccatattgtccgctgccttggcaaaagagtatccgcaagcct

SEQ ID NO: 14927 - RNA, 131 nt, unidentified
  source 1..131: mol_type = other RNA; note = Related to NZ_JACIFL010000022.1; note = Rhizobium sp.
aagcttgcggatagattctgctgttgttgtttcggcgatagttgatatcaatgcagggcttactgcctctacattccttccggactgctccacacggtccgacgctatggcgaacgagtatccgcaagccc

SEQ ID NO: 14928 - RNA, 132 nt, unidentified
  source 1..132: mol_type = other RNA; note = Related to NZ_WPHT01000004.1; note = Agrobacterium vitis
tggcttgcggatagattctgctgttgtgtttcgcgatagttgataccaatgcgcggggcattgcccgacgcattcctcacggactgtcatccgctggtccaccgaccttggcaaacgagtatccgcaagcct

SEQ ID NO: 14929 - RNA, 131 nt, unidentified
  source 1..131: mol_type = other RNA; note = Related to JAAMEU010000005.1; note = Agrobacterium rhizogenes
aggcttgcggatagattctgctgttgtgtttcgcgatagttgataccagtgcgcggggcattgccctacgcattccttacggactgttcacccatggtccgatgacttggcaaacgagtttccgcaagcct

SEQ ID NO: 14930 - RNA, 130 nt, unidentified
  source 1..130: mol_type = other RNA; note = Related to NZ_ANNO01000019.1; note = Pseudochrobactrum sp.
aggcttgcggatagattctgctgttgtgcttcgcgatagttgataccaatgcgcgggccattgcccatgcattccttacggactgttctcggatcgtccgataacttggcaaacgagtgtccgcaagccc

SEQ ID NO: 14931 - RNA, 131 nt, unidentified
  source 1..131: mol_type = other RNA; note = Related to NZ_AP023262.1; note = Mesorhizobium sp.
gtgcttgcggatagattctgctgttgttgtttcggcgatagttgatatcaatgcgcggggttctgcccgcacattccttacggactgtatacccatgtccgatgctctggcatacgagtatccgcaagcca

SEQ ID NO: 14932 - RNA, 129 nt, unidentified
  source 1..129: mol_type = other RNA; note = Related to JAJGNB010000034.1; note = Aurantimonas coralicida
tggcttgcggatagatttttctgttgtgcttcgcgacagttgactacatggctcgggggattgcccccgcgaccaccctgtgatcgttattcgagattatgcgtatggcgaacgagtatccgcaagcca

SEQ ID NO: 14933 - RNA, 129 nt, unidentified
  source 1..129: mol_type = other RNA; note = Related to NZ_VFVY01000001.1; note = Mesorhizobium sp.
cggcttgcggatagattttgctgttatgtatcgtgacagttgatattattgcaccaggcaatgcctgggcactccttccggattgcttcatgcgacccgatcgtatggcgtacgagtatccgcaagccc

SEQ ID NO: 14934 - RNA, 125 nt, unidentified
  source 1..125: mol_type = other RNA; note = Related to NWTG01000019.1; note = Bradyrhizobium sp.
cggcttgcggatagatttttctgttgtgcttcgcgacagttgatatgaatgccacgggtaatgcgcgctccttgcagatcgctatgatcggacgacacatctggcgtacgagtatccgcaggccg

SEQ ID NO: 14935 - RNA, 125 nt, unidentified
  source 1..125: mol_type = other RNA; note = Related to JAGKJI010000032.1; note = Bradyrhizobium sp.
cggcttgcggatagattttgctgttgtgcttcgcgacagttgatatgaatgcacgcgggaatgcgcgctccttgcagatcgctatgatcgtgcgaacaatctggcgtacgagtatccgcaagccg

SEQ ID NO: 14936 - RNA, 125 nt, unidentified
  source 1..125: mol_type = other RNA; note = Related to NZ_CP086136.1; note = Bradyrhizobium sp.
aggcttgcggatagattttgctgttgtgcttcgcgacagttgatatgaatgcgcgtaggaatgcgcgctccctgcagttcgctgcgactatgcgtccgatctggcgtacgagtatccgcaagcct

SEQ ID NO: 14937 - RNA, 138 nt, unidentified
  source 1..138: mol_type = other RNA; note = Related to RPJW01000006.1; note = Sinorhizobium medicae
cagctcgcggatagatttttctgtcgtgtttcgcgacggttgagtgcagtgccacggtcaatgctaattacagcatgggccggcaatggttaaaatcctatcgttatctgacgatcgccaacgagtatccgcgagcct

SEQ ID NO: 14938 - RNA, 137 nt, unidentified
  source 1..137: mol_type = other RNA; note = Related to JAAMCX010000003.1; note = Agrobacterium rhizogenes
ttgctcgcggatagatttttctgtcgtgtttcgcgacggttgattacactgtcacggtcaatgctgatcacagtatgggctgatatggtttaaatcctatcgttatctgacgatcgccaacgagtgtccgcgagcct

SEQ ID NO: 14939 - RNA, 138 nt, unidentified
  source 1..138: mol_type = other RNA; note = Related to NZ_VDMN01000001.1; note = Rhizobium smilacinae
ctgctcgcggatagatttttctgtcgtgtttcgcgatggttgactacgccgttacggtcaatgctgaatacagtacggaccgctatactgtaaaatcctatcgtcacctgacggtcgccaacgagtatccgcgagcct

SEQ ID NO: 14940 - RNA, 138 nt, unidentified
  source 1..138: mol_type = other RNA; note = Related to JACVAS010000003.1; note = Ensifer sp.
gagctcgcggatagatttttccgtcgtgtttcgcgacggttgagtgcgctgtggcggtgaatgctttccgagagtatgacccgacacggttcgaattctatcgttatctgacaatcgccaacgagtatccgcgagctt

SEQ ID NO: 14941 - RNA, 136 nt, unidentified
  source 1..136: mol_type = other RNA; note = Related to SADI02000019.1; note = Mesorhizobium sp.
ccgctcgcggatagatttttctgtcgtgcttcgcgacagttgaatgtactatgagggccgatgctttccacagcgtggacctcgacggaatgacctgatcaacatccgacaatcgcctacgagtatccgcgagcct

SEQ ID NO: 14942 - RNA, 132 nt, unidentified
  source 1..132: mol_type = other RNA; note = Related to VCHT01000005.1; note = Rhizobium sp.
gggcttgcggacagattttgttgccaagtttcatggcagttgaaaccattgttgggtgatttgcctgacgatacttacagacgatgcaatattggataattcctacgttcgcataagagtgtccgcaagcct

SEQ ID NO: 14943 - RNA, 131 nt, unidentified
  source 1..131: mol_type = other RNA; note = Related to CP050308.1; note = Rhizobium lusitanum
gggcttgcggacagattttgttgccaagtttcatggcagttgaaaacattgtcaggcagtttgcccgacgatacttccagatgatgggatttgtataatatctccgctcgcataagagtgtccgcaagcct

SEQ ID NO: 14944 - RNA, 131 nt, unidentified
  source 1..131: mol_type = other RNA; note = Related to NZ_KZ857258.1; note = Rhizobium grahamii
gggcttgcggacagattttgttgccaagtttcatggcagttgaaagcatggtcaggcggtttgcccgacaatacctacagatgatgcgctattggacaattcgtccttcgcaaaagagtgtccgcaagcct

SEQ ID NO: 14945 - RNA, 143 nt, unidentified
  source 1..143: mol_type = other RNA; note = Related to JACIGM010000003.1; note = Rhizobium mongolense
aggcttgcggatagattttggtgtcatggctcgtgacacttgaaaacaatgctgccggcaatgctgacaggttcctccgatcgctggtccgactgatacacacgggctatgcgcttcaatcgcatacgagtatccgcaagccc

SEQ ID NO: 14946 - RNA, 141 nt, unidentified
  source 1..141: mol_type = other RNA; note = Related to SIOG01000001.1; note = Rhizobium leguminosarum
aggcttgcggatagattttggtgtcgtgtgttcgtggcacttgaaagaaatgctgccagcaatgctgaacagttatccgcatgtccattcaatattggatatctactatgcgctacatcgcatacgagtatccgcaagcct

SEQ ID NO: 14947 - RNA, 142 nt, unidentified
  source 1..142: mol_type = other RNA; note = Related to NZ_JABEPP010000002.1; note = Enterovirga sp.
cggcttgcggatagattttgcggcgctgcttcggcgtcgttgaagtcaatgtctgggcgatgctccagcctttgaactgcctttcgaacaggcgaatgacaatgcatagaatgcgaatacgcgtacgagtatccgcaagcca

SEQ ID NO: 14948 - RNA, 137 nt, unidentified
  source 1..137: mol_type = other RNA; note = Related to NZ_LSKN01000098.1; note = Methylobacterium sp.
cgacttgcggatagatttttctacaatgtttcgttgtagttgaaaccatcgtggagccgactgctctccgaacactgaccgacattatatgatcccggcaaatatgcgcgaagacgcataagagtatccgcaagtcg

SEQ ID NO: 14949 - RNA, 143 nt, unidentified
  source 1..143: mol_type = other RNA; note = Related to JAAXSB010000004.1; note = Rhizobium laguerreae
atgcttgcggatagatttttctatgatgcttcgtcatagttgccatcgttgtggaggcgtttgctttcccgacttcctaatgattcgatttcggataatctaatatacgatttcgactttcgcataagagtatccgcaagcat

SEQ ID NO: 14950 - RNA, 136 nt, unidentified
  source 1..136: mol_type = other RNA; note = Related to NZ_CP015318.1; note = Mesorhizobium amorphae
aggcttgcggatagattttgctgtgatgattcgtcacagttgaaaccatcgtggagggttttgctctcccggtacctgacgactccgaatggggcctgcatgatctgcgaatgcgcaaacgagtatccgcaagccg

SEQ ID NO: 14951 - RNA, 144 nt, unidentified
  source 1..144: mol_type = other RNA; note = Related to VFVE01000003.1; note = Mesorhizobium sp.
cggcttgcggatagatttttctgtgggggttctccacagttgaaagcaagacggccttagtgcttcccgaagtatcccgacgagaagcagcatgtaacggtatgacgatgacacgcgaagtcgcgtaggagtatccgcaagccg

SEQ ID NO: 14952 - RNA, 138 nt, unidentified
  source 1..138: mol_type = other RNA; note = Related to CP015005.1; note = Aminobacter aminovorans
cggcttgcggatagatttttctgtgggggttctccacaggtgaaagcaagacggccttagtgcttcccgaagagggacgacgaggagcattacgttaagcgaccatacgctggatcgcgtaggagtatccgcaagcct

SEQ ID NO: 14953 - RNA, 139 nt, unidentified
  source 1..139: mol_type = other RNA; note = Related to JAIUGR010000007.1; note = Mesorhizobium sp.
cggcttgcggatagatttttctgtgggggatcttcacaggtgaaagcaagacggcctcagtgctacctgcagagtgccgacagtaacatgacgatatgggcgatactacgctgaatcgcttaggagtatccgcaagcca

SEQ ID NO: 14954 - RNA, 139 nt, unidentified
  source 1..139: mol_type = other RNA; note = Related to CAAF010000028.1; note = Mesorhizobium sp.
tggcttgcggatagatttttctgtgggggttctccacaggtgaaagcaatacggcctcaacgctacctgcagagagccgacgagagcatgacgatttgggcgataatacgctggatcgcgtaggagtatccgcaagcca

SEQ ID NO: 14955 - RNA, 144 nt, unidentified
  source 1..144: mol_type = other RNA; note = Related to NZ_JHQU01000117.1; note = Mesorhizobium mediterraneum
tggcttgcggatagatttttctgtgggggttcctcacaggtgaaaccaacacggccttagtgctgcccgaagagcgacgacgagaagcagcatataacggtataacggcaatacgcgaagtcgcgtaggagtatccgcaagcca

SEQ ID NO: 14956 - RNA, 136 nt, unidentified
  source 1..136: mol_type = other RNA; note = Related to SAKE01000022.1; note = Mesorhizobium sp.
cggcttgcggatagatttttctgtgggggttcctcacaggtgaaggcaagacggctctagtgcttcccggagaatgcgacgagggcgatacgttatggtccattatgctacatcgcataggagtatccgcaagccg

SEQ ID NO: 14957 - RNA, 137 nt, unidentified
  source 1..137: mol_type = other RNA; note = Related to RZTV01000003.1; note = Mesorhizobium sp.
cggcttgcggatagatttttctgtggggactctccacaggtgaaagcaacgtggctctagtgcttcccgaaggggcaacgaagagcaatacatcgagtctacaatacgctagatcgcataagagtatccgcaagtcc

SEQ ID NO: 14958 - RNA, 126 nt, unidentified
  source 1..126: mol_type = other RNA; note = Related to NZ_AJQB01000700.1; note = Bradyrhizobium japonicum
cggcttgcggacagatttttctatcatgcgttcgtgatagttgaaaccaatgcctgtcagaatgcctctgcaggtcccaacgcttaaggatccgctcgttgagcgccaaagagtgtccgcaagcca

SEQ ID NO: 14959 - RNA, 128 nt, unidentified
  source 1..128: mol_type = other RNA; note = Related to JACIHC010000005.1; note = Bradyrhizobium sp.
cggcttgcggacagatttttctatcatgcgttcgtgatagttgaaaccaatgcctgcgagaatgccactgcaggtcctaacgcttaagggtatccgctcgttgagcgccaaagagtgtccgcaagcca

SEQ ID NO: 14960 - RNA, 125 nt, unidentified
  source 1..125: mol_type = other RNA; note = Related to NZ_AP022641.1; note = Bradyrhizobium diazoefficiens
cggcttgcggacagatttttctatcatgtttcgtgatagttgaaaccaacgccggcaagactgcctcggcagatctcaacgctcaagacgatgctcgacgagcgcataagagtgtccgcaagcca

SEQ ID NO: 14961 - RNA, 125 nt, unidentified
  source 1..125: mol_type = other RNA; note = Related to NZ_JHQS01000008.1; note = Mesorhizobium amorphae
aggcttgcggacagattcttctatcatgtttcgtgataggtggaaaagttgctggggtggattgcccacctgcggtttctacaatttatcgatgtctcttcgtgcctaggagtgtccgcaagccg

SEQ ID NO: 14962 - RNA, 126 nt, unidentified
  source 1..126: mol_type = other RNA; note = Related to NZ_KB913026.1; note = Mesorhizobium loti
tggcttgcggacagatttttctatcatgattcgtgataggtgacgcaattgccgcagggattgcctacctgcggtttctacaagcttttcgtgacttgacgtgcgctaaagagtgtctgcaagcca

SEQ ID NO: 14963 - RNA, 127 nt, unidentified
  source 1..127: mol_type = other RNA; note = Related to JACIZA010000145.1; note = Phenylobacterium sp.
aagcttgcggatagatcttgctgccgtgcttcgcggcggttgatgggacgttccaatgaatgcccctacgacgattccaaatattacatgtaaacccacgggtttgccaaagagtatccgcaagcca

SEQ ID NO: 14964 - RNA, 129 nt, unidentified
  source 1..129: mol_type = other RNA; note = Related to JACJIU010000009.1; note = Rhizobium leguminosarum
tgatccgcaggcagatttttccgccatgtattgtggcggctataaagagcgtacagtgggattttccctacgcgccttatccttacggttcgctaaaccgtgttccgacgaaagagtgcttgcggatcg

SEQ ID NO: 14965 - RNA, 128 nt, unidentified
  source 1..128: mol_type = other RNA; note = Related to CP090117.1; note = Rhizobium leguminosarum
tgatccgcaggcagatttttccgccatgtattgtggcggctataaagagcgtacaacgggattttccctacgcgccttatacttacggttcgaaaaccgcgtattgacgaaagagtgcttgcggatcg

SEQ ID NO: 14966 - RNA, 128 nt, unidentified
  source 1..128: mol_type = other RNA; note = Related to NZ_CP054023.1; note = Rhizobium sp.
agatccgcaggcagatttttccgccatgcattgtggcggctataaagagcgtacagagggattttccctacgcaccttaagactgacggttaataaccgtgtgacgacgaaagagtgcttgcggatcg

SEQ ID NO: 14967 - RNA, 126 nt, unidentified
  source 1..126: mol_type = other RNA; note = Alphaproteobacteria bacterium; note = Related to JAHIXO010000053.1
cgatccgcaagcagattcttctgccatgcattgtggtgggtagaaagattgtacgctgggatttttcctacgcgccttacattcacggtaaaaaccgtgtgcttactaaagagtgcttgcggatca

SEQ ID NO: 14968 - RNA, 125 nt, unidentified
  source 1..125: mol_type = other RNA; note = Related to JAALYX010000005.1; note = Agrobacterium tumefaciens
tgatccgcaagcagatttttctgccatgtattgtggtgggtataaagattgtacgctgggatttatcctacgcgccttactataccgataataatcgtgtattactaaagagtgcttgcggatca

SEQ ID NO: 14969 - RNA, 128 nt, unidentified
  source 1..128: mol_type = other RNA; note = Related to NZ_RPKX01000022.1; note = Sinorhizobium meliloti
tgatccgcaagcagattcttctgccatgtattgtggcggctataaagaacgtagcctggggttttccccttacgtaccttgatattacggttaaatcaccgtgtgaacgaaagagtgcttgcggatca

SEQ ID NO: 14970 - RNA, 127 nt, unidentified
  source 1..127: mol_type = other RNA; note = Related to WISN01000076.1; note = Sinorhizobium meliloti
tgatccgcaagcagattcttctgccatgtattgtggcggctataaagaatgtagggcgggttttccaccttacgtaccttgatattacggttttaaaccgtgtgtacaaaagagtgcttgcggatcg

SEQ ID NO: 14971 - RNA, 126 nt, unidentified
  source 1..126: mol_type = other RNA; note = Related to NZ_FOPG01000001.1; note = Sulfitobacter dubius
cgatccgcaagtagatttttccgccattttttgtggcggctataaatattgtggccggggtttccctgagcaccttacagataatggtataacaccatgcgactgctaaagagtgcttgcggatca

SEQ ID NO: 14972 - RNA, 125 nt, unidentified
  source 1..125: mol_type = other RNA; note = Related to NZ_SAUW01000046.1; note = Sinirhodobacter populi
agatccgcaagcagatccttccatcatgcattgtgatggctatacagaacgtcagcgggctttcctcctgcgtatccttacattacggttaattaccgtgttgacgaaagagtgcttgcggatca

SEQ ID NO: 14973 - RNA, 135 nt, unidentified
  source 1..135: mol_type = other RNA; note = Related to NZ_QNQP01000022.1; note = Pelagivirga dicentrarchi
cagccttcgggcagattttgtcatcatgttcattgtgatggttggccgcaacgctggtcagatttgctcttcgagttcctttgcagttttacggattgtagaaatccttgcctgcgtaagagtgcccgaaggcta

SEQ ID NO: 14974 - RNA, 132 nt, unidentified
  source 1..132: mol_type = other RNA; note = Related to NZ_MNBL01000032.1; note = Nioella sediminis
tagcttgcgggtagattttgtcgtcgtgcttcatgacgtttgcacccattgttaggtgtgatgctctcttcgagttccctttagtcttcctcatgtaaacctctggtttgcctaaggagtactcgcaagcgc

SEQ ID NO: 14975 - RNA, 134 nt, unidentified
  source 1..134: mol_type = other RNA; note = Related to LMGC01000024.1; note = Ensifer sp.
aagcttgcgggcagatcttgtcgtcgcgcatcgcgacggttgctgacaatgtcaggcctgattgctccttccggagtacccttacgttcatctacgggaaatcccgtgacacgcatacgagtgcccgcaagcga

SEQ ID NO: 14976 - RNA, 134 nt, unidentified
  source 1..134: mol_type = other RNA; note = Related to AGVV01000148.1; note = Sinorhizobium meliloti
acgcttgcgggtagatcctgtcgtcgcgcatcgcgatggttgctgacaatgtcaggcctgattgctcctctcggagtacctttacgttattctacgggaaatcccgtgacacgcatacgagtacccgcaagcga

SEQ ID NO: 14977 - RNA, 134 nt, unidentified
  source 1..134: mol_type = other RNA; note = Related to NZ_SIQZ01000001.1; note = Rhizobium leguminosarum
aagcttgcgggtagatcctgtcgtcgcgcatcgcgacggttgctgacaatgtcaggcctgattgctccttccggagtacccttacgttcttctacgggaaatcccgtgacacgcatacgagtgcccgcaagcga

SEQ ID NO: 14978 - RNA, 143 nt, unidentified
  source 1..143: mol_type = other RNA; note = Related to NZ_CP053347.1; note = Sphingomonas sp.
aggaccgtgaacagaattttctgctgagtttcttggcagttgagaagtacgcgagcagcgcttgctgctatgatgcgatcatgatgatatgatgttatgatgatcgattgacgatgatatcgcataagagtgttcacggtcca

SEQ ID NO: 14979 - RNA, 142 nt, unidentified
  source 1..142: mol_type = other RNA; note = Related to NZ_BJVS01000002.1; note = Asaia bogorensis
aggatcgtgaacagatttttccgctgagtttctcggtggttgagaagtacgcaggcgccgcttgcttgtagtatacccaacaggaatacgatatcttaatgtcgaaatgactccgttatcgcaaaagagtgttcacgatccg

SEQ ID NO: 14980 - RNA, 142 nt, unidentified
  source 1..142: mol_type = other RNA; note = Related to NZ_CP019511.1; note = Sphingomonas sp.
agggccgtggatagattttactgccgagtttcttggcagctgagaagtatgcgagcatcgctcgctaatacgatccagcaatgatgatgcgctttgagttacacatgcgacaccgcgtcgcctaaggagtgtccacggcccg

SEQ ID NO: 14981 - RNA, 141 nt, unidentified
  source 1..141: mol_type = other RNA; note = Related to NZ_CP032570.1; note = Tsuneonella amylolytica
gcgaccgtgggcagaacgtactattgagaatctcgatagctgagtagtaagcaagcaacgctagcttctctgatgggactacttgaaatatttcttttacaatgtaacgcgacgttaccgcgtaggagtgcccacggtcac

SEQ ID NO: 14982 - RNA, 148 nt, unidentified
  source 1..148: mol_type = other RNA; note = Related to JADBDT010000001.1; note = Sphingopyxis sp.
gggcctgtgagcagaaccttctgctgaagtttcgcggcagttgaatagtatgcgaggatttcttgctactggataaatcgacaatgatgatccgaataggacaattaatgcggattcaccggaatcgcatgagagtgctcacaggccc

SEQ ID NO: 14983 - RNA, 122 nt, unidentified
  source 1..122: mol_type = other RNA; note = Related to LXYU01000002.1; note = Bartonella apis
aaactcacaggtagaagtgttatcttgtttcgagatatatttgttaatatcgacagctttgcttagctggtctacatgtgttactaagtaggtaagcttagtctaagagtacctgtgagttt

SEQ ID NO: 14984 - RNA, 136 nt, Vibrio parahaemolyticus
  source 1..136: mol_type = other RNA; note = Related to NZ_CP013248.1
tcgcttacgggcagaatttgagttgtgtatcgcaacttttgatataaatggcacgtgctatttgctacctttcggctattcgtctgatgaccaatagtttatcgttctacaatcgcgtaggagtgcccgtaagcaa

SEQ ID NO: 14985 - RNA, 137 nt, unidentified
  source 1..137: mol_type = other RNA; note = Related to NZ_CP058972.1; note = Pseudoalteromonas sp.
acgcttacgggcagatttggactgcgcatcgcagtttttgatttatatgttactttgtgtttgctaccttatcggctcgtccgggtatgttgacgattcatcctatcatcatttcgcaaaagagtgcccgtaagccc

SEQ ID NO: 14986 - RNA, 148 nt, unidentified
  source 1..148: mol_type = other RNA; note = Related to NZ_VJWL01000003.1; note = Aliidiomarina halalkaliphila
tggcttacgggcagaatttgggttgcgcatcgcaatctttgatacaaaagtctcgttacatttgctacctagcggtcgtccggtcggtttacatcgattcgactagtcgccctatgttttctcaaagcgtaggagtgcccgtaagcca

SEQ ID NO: 14987 - RNA, 130 nt, unidentified
  source 1..130: mol_type = other RNA; note = Related to JABWTP010000017.1; note = Photobacterium damselae
acgcttacgggcagattttgagttgtgtatcgcaacttttgatataaatgctgaactgcatttgcttaccttatggccatactggccaattactcgttaattcttaacgcataagagtgcccgtaagcat

SEQ ID NO: 14988 - RNA, 130 nt, Vibrio sp.
  source 1..130: mol_type = other RNA; note = Related to PIEV01000027.1; note = Vibrio splendidus
ctgcttacgggcagattttgagttgtgtatcgcaacttttgatacaaatgctgaactgtatttgcttaccttatggcctaaccggccagttactcgttaattcttaacgcataagagtgcccgtaagcac

SEQ ID NO: 14989 - RNA, 130 nt, unidentified
  source 1..130: mol_type = other RNA; note = Related to NZ_CP025583.1; note = Paracoccus sp.
gagcctgtgggcagattttaccgttgtgcttcgcgacggatgaaaccaccgtcaggtggatatgccctatcgggtttccttcagcatatcttatgtgacccttcggttgcctaggagtgcccatgggctc

SEQ ID NO: 14990 - RNA, 131 nt, unidentified
  source 1..131: mol_type = other RNA; note = Related to NZ_KE557310.1; note = Litoreibacter arenae
gagcgcgtgggcagattttaccgttgtgcgttcgcaacggatgaaaccactgttaggtggatatgccctatcgggtttccttcagcatattttatgtgacccttcggttgcctaagagtgcccacgggctc

SEQ ID NO: 14991 - RNA, 129 nt, unidentified
  source 1..129: mol_type = other RNA; note = Related to NZ_JABVAX010000004.1; note = Jannaschia marina
gagcctgcgggcagattttaccgctgtgtttcgcagtggatgaaaccatcgtcgggtggatatgctccttccgtcatctttgcatatcttatgagacacttacgtttgcataggagtgcccgcaggctc

SEQ ID NO: 14992 - RNA, 126 nt, Vibrio parahaemolyticus
  source 1..126: mol_type = other RNA; note = Related to AAXMXP010000003.1
cggtttacaggcagattttgttattgcgtttcgcaataagtgaaaataatgttggaaacaaatgctcatattatgagatgcatcgtgaaaatgggctgcgccgagccagagagtgcctgtaaacca

SEQ ID NO: 14993 - RNA, 126 nt, Vibrio sp.
  source 1..126: mol_type = other RNA; note = Related to NZ_JAHAMV010000022.1; note = Vibrio metschnikovii
aggcttacaggcagatttttttattgcgcttcgcgataagtgaaaaagacgttggaaacaaatgctcatattacggtaatgctcctgaaaatgggctgcgccgagcaaaggagtgcctgtaagctc

SEQ ID NO: 14994 - RNA, 129 nt, unidentified
  source 1..129: mol_type = other RNA; note = Related to NC_016026.1; note = Micavibrio sp.
aggcttacggacagaaatttgattgtgattcgcaatctatgaaaaaaatgttaggcaagtaagctgctacattcaacccgcatgctatgatgagggcaccccctcaggcaaaagagtgtccgtaagcca

SEQ ID NO: 14995 - RNA, 126 nt, unidentified
  source 1..126: mol_type = other RNA; note = Related to NZ_WTYR01000001.1; note = Alteriqipengyuania halimionae
agatctgcgggcagattttttgtagtgtttcgctacacgtgaaaagaatgtgagagggaattgcccctatcgtatacactttgcaatccttatgtgatgttatcgcgtaggagtgcccgcagatcg

SEQ ID NO: 14996 - RNA, 142 nt, unidentified
  source 1..142: mol_type = other RNA; note = Related to NZ_AUBC01000017.1; note = Salinarimonas rosea
gggttggcaggtagtttcgttgccgcgtttcgtggcatgagaaaaaatggccagggttcgtctgcttccttggcttctttatgcatctcggcttactcgatttgagatgcggactacatcgcataagagtacctgccaaccc

SEQ ID NO: 14997 - RNA, 140 nt, unidentified
  source 1..140: mol_type = other RNA; note = Leptolyngbyaceae cyanobacterium SM1_4_3; note = Related to JAAUTN010000370.1
ggacttgtaggcagattttatgtcatgtttcgtgacacttgaaacaaatgctgaaagcatagctttcagtgttttctatagcacttagcattagctatgtttggtgttcttcgcgttcgcaaaggagtgcctgcaagtcc

SEQ ID NO: 14998 - RNA, 140 nt, unidentified; identical to SEQ ID NO: 14997
  source 1..140: mol_type = other RNA; note = Related to JAAUQZ010000187.1; note = Leptolyngbyaceae cyanobacterium RM1_406_9

SEQ ID NO: 14999 - RNA, 136 nt, unidentified
  source 1..136: mol_type = other RNA; note = Related to JAAUUH010000063.1; note = Oscillatoriales cyanobacterium SM2_2_1
ggacttgtaggcaaattttgtgtcatgcttcgtgacacttgaaacaaatgctgctgccaatgctgacagtgaatccctatagtacataacatgcttatgataccttctgcgttcgcaaaggagtgcctgcaagtcc

SEQ ID NO: 15000 - RNA, 134 nt, unidentified
  source 1..134: mol_type = other RNA; note = Related to PHCH01000051.1; note = Betaproteobacteria bacterium HGW-Betaproteobacteria-4
gggcctacagacagaccttgtgccattgtttcgtggcatttgaaaaaaatgttgggggctatgctctcggcggtcctatccatgtgggtaaccttggggttcccatagcgtcgcgtaagagtgtctgtaggccc

SEQ ID NO: 15001 - RNA, 136 nt, unidentified
  source 1..136: mol_type = other RNA; note = Related to NCKJ01000107.1; note = Halothiobacillus sp.
gggcttgctgatagatttttttgccacgtatcgtggcaagtgaaactaacggcagaagctatgctgctgttatgctgattttcccttgagttgagcaaaggtttgcgcggtaacgcgtaggagtatctgcaggccc

SEQ ID NO: 15002 - RNA, 128 nt, unidentified
  source 1..128: mol_type = other RNA; note = Burkholderiaceae bacterium 16; note = Related to JYOD01000041.1
gggcttacaggcagattttttaccatgtttcgtggtaagtgacaccaatgtccggggctatgccctcgatatctctcataaatcgcatattacgccatatgcgcctgcaaaagagtgcctgtaagcct

SEQ ID NO: 15003 - RNA, 133 nt, unidentified
  source 1..133: mol_type = other RNA; note = Burkholderiales bacterium PBB6; note = Related to NKIH01000004.1
gggcttagtggcagattttttgccatgtttcgtggcatgtgaaagcaatgtctggagctatgctcctcgactatctcctctacagtgattccttgaggatctctgcgtctcgcgagagagtgccactaggtcc

SEQ ID NO: 15004 - RNA, 136 nt, unidentified
  source 1..136: mol_type = other RNA; note = Burkholderiales bacterium; note = Related to JACZJU010000112.1
gggcctacagacagaccttgtgctgcgtatcgtggcacgtgaaataaatggcgagcggtatgctgcctatcgcctccttgacgcatcgacaaggtaacttgtccctgttgaatcgcgtaagagtgcctgtaggccc

SEQ ID NO: 15005 - RNA, 134 nt, unidentified
  source 1..134: mol_type = other RNA; note = Related to SHXF01000114.1; note = Betaproteobacteria bacterium
gggcctacagacagaccttgtgctgcgcttcgtggcacgtgaaataaatggcgagcggtatgctgcccttcgcctctttgacggatcgacgatggacttgtcgcctggtatcgcgtaagagtgtctgtaggccc

SEQ ID NO: 15006 - RNA, 143 nt, unidentified
  source 1..143: mol_type = other RNA; note = Related to JADJFI010000002.1; note = Sulfuritalea sp.
gggcctacgggcagatcttgcgttatggaatcgtaacgcgtgaaattaatggcactaacgttttgctccttaccgtatcccttcacggtatgcaattattcagcatatccatttgcgggacgcataagagtgctcgtaggccc

SEQ ID NO: 15007 - RNA, 140 nt, unidentified
  source 1..140: mol_type = other RNA; note = Related to NZ_CP036357.1; note = Bordetella trematum
tggcccataagcagatttttttgccattgtttcgtggcaagtgacaacaacggcaggagcattgctcctgtacgccccataatccctagtagttgactgggatatatccattgcatacgcttaggagtgcttgtgggcca

SEQ ID NO: 15008 - RNA, 145 nt, unidentified
  source 1..145: mol_type = other RNA; note = Related to NZ_NEVN01000010.1; note = Bordetella sp.
gggcctacagacagattttttgccatcgtttcgtggcacgtgacaccaaaggcaggtgcattgctactatccatgtgcctgccacagtaaatccatgagtaaaatggaatgttctcagcattcgcataggagtgtctgtaggccc

SEQ ID NO: 15009 - RNA, 140 nt, unidentified
  source 1..140: mol_type = other RNA; note = Related to NEVU01000001.1; note = Bordetella sp.
cggcctacaggcagattttttgccatcgtttcgtggcatgtgacagtaatggcaggtgcattgctcctgtcggtcccattaagcctcatgagtccatcatgtggtgtctgcgcatagcgcataggagtgcctgtaggcca

SEQ ID NO: 15010 - RNA, 135 nt, unidentified
  source 1..135: mol_type = other RNA; note = Related to NZ_JACHGB010000002.1; note = Quisquiliibacterium transsilvanicum
cggcccctgggcagacgttttgtggcgtttcgccacaagtgcaatagctgggggaggcgttgcctccttactgctaccttatatctcgatttctcatgagatggtatgtcttcgcgtaagagtgcccaggggcca

SEQ ID NO: 15011 - RNA, 132 nt, unidentified
  source 1..132: mol_type = other RNA; note = Related to JAAZTX010000005.1; note = Acidithiobacillus ferriphilus
tggctcaccggcagactttgtgccatgtttcgtggcatttgaaacaaacgctaggaagtatgcttctcttcctagacgtgtctgatagtgccagagtgtcagtgtctatcgcgtaggagtgccggtgtgcct

SEQ ID NO: 15012 - RNA, 130 nt, unidentified
  source 1..130: mol_type = other RNA; note = Related to QHVH01000010.1; note = Blastocatellia bacterium AA13
agactcaccggtagattttgtgccatgcttcgtggcatttgaaacaaatgtgagagggtatgccgacatagccttgcgacttgctctctaccatgcaatatgactttcgcgtaggagtaccggtgggtcg

SEQ ID NO: 15013 - RNA, 136 nt, unidentified
  source 1..136: mol_type = other RNA; note = Related to JADBLS010000169.1; note = Chloroflexi bacterium
agactcaccggcagatcttgtgccatgcttcgtggcatttgaagcaaatgtgagagggtatgctgactcacagcgcatgtgagtatgcgcatatccgtttcgctgtatgacttcgcgtaggagtaccggtgagtcg

SEQ ID NO: 15014 - RNA, 148 nt, unidentified
  source 1..148: mol_type = other RNA; note = Candidatus Nitrospira kreftii; note = Related to CP047423.1
agacgcaccggtagattttgtgccatgtttcgtggcatttgaaagaaatgtaaaaggctatgctgctcaccgtgtgcgccacacttcgcatggggtgcagtgtatcttgtgtctcgcgtgtctatcgcgtaggagtaccggtgcgtca

SEQ ID NO: 15015 - RNA, 134 nt, unidentified
  source 1..134: mol_type = other RNA; note = Related to JACQSX010000029.1; note = Acidobacteria bacterium
ggacccactaggcagactttgtgccatgtttcgtggcatttgaaacaaacgttagatcctatgctgtcctcgccgtgaatggcgatggtcctcgcgactctctcgtgtcttcgcgaaggagtgccggtgggtca

SEQ ID NO: 15016 - RNA, 131 nt, unidentified
  source 1..131: mol_type = other RNA; note = Bryobacterales bacterium; note = Related to JADZCM010000017.1
ggacccactcggcagattttgtgccatgtttcgtggcatttgaagcaaaggtcgggtactatgctgattctcgtctgcagatacgctgtatctgctggtgactggcttcgctaaggagtgccggtgggtct

SEQ ID NO: 15017 - RNA, 128 nt, Achromobacter sp.
  source 1..128: mol_type = other RNA; note = Related to JABBJN010000001.1
ccgcccaccgacagagtttgtgccatgtttcgtggcacgtgaaacaaaatggccgaggctttgcccggttacgttaatgtaagcaacgccattagtggtctcaactgcgtaagagtgtcggtgggctc

SEQ ID NO: 15018 - RNA, 131 nt, unidentified
  source 1..131: mol_type = other RNA; note = Related to NZ_CP088952.1; note = Massilia sp.
agacctgcggtcagaccttgtgtcgcgattcgcgatacgtgtatcaattgtggggggctatgcttcctatcgatatcctagcagaagtagtcatggtgagccgtgcgccgccaaagagtttccgcaggtct

SEQ ID NO: 15019 - RNA, 130 nt, unidentified
  source 1..130: mol_type = other RNA; note = Related to NZ_CP080379.1; note = Massilia sp.
agacctacggaaagactttgtatcgcgattcgcgatacgtgtttcaattgcttagggctatgccctcgtcgatgtccttgcatgggagcttgactgttaccatgcgttgccaatgagtttccgtgggtct

SEQ ID NO: 15020 - RNA, 130 nt, unidentified
  source 1..130: mol_type = other RNA; note = Related to NZ_RXLQ01000009.1; note = Massilia atriviolacea
gggcctgcggtcagaccttgtaccgcgattcgcggtacgtgtatcaatggcttgggcctatgccctcgtcgatgtccttacatgattacttgaatgtagccatgcgtcgcaaatgagtgtccgcaggtcc

SEQ ID NO: 15021 - RNA, 135 nt, unidentified
  source 1..135: mol_type = other RNA; note = Related to JAHCDN010000001.1; note = Variovorax sp.
gagcttgcaaacagatttttcaccatgtttcgtggtgatggacaacgatagtaggggctatgcccgttattccttaatcgtgtgagttgagcccgacgacaagggtgtcttccgcataagagtgtttgcaagctc

SEQ ID NO: 15022 - RNA, 138 nt, unidentified
  source 1..138: mol_type = other RNA; note = Related to NZ_JAGSTT010000006.1; note = Burkholderia cenocepacia
ccgctttcgggcagaccttttgccatgtttcgtggcatgtgacaccaacggccgggacgttgctcctagtcgatatctcgccttaatagctgatcgcacgaatagcgattgcatacgcgtaagagtgcccgaaagccc

SEQ ID NO: 15023 - RNA, 124 nt, unidentified
  source 1..124: mol_type = other RNA; note = Related to FXAT01000001.1; note = Paraburkholderia susongensis
cagctcgcggatagattttttgccatgaatcatggcatgtgaaataaaagttccgggatttgctcctcggatttcctctgcattatccgaattgcgccgtttgcgtaagagtatccgcgagcca

SEQ ID NO: 15024 - RNA, 128 nt, unidentified
  source 1..128: mol_type = other RNA; note = Related to SMOD01000073.1; note = Paraburkholderia guartelaensis
cgactcgcggatagattttttgccatcgtttcatggcatgtgaagcaaatgttcgtggatatgctcctcggtatccctctatatattgcgagataatcgcagaaatgcgtaggagtatccgcgagtct

SEQ ID NO: 15025 - RNA, 132 nt, unidentified
  source 1..132: mol_type = other RNA; note = Related to NZ_LMNW01000004.1; note = Duganella sp.
ttgcttgcggatagattttttgccattgtttcatggcatgtgaaataaatgttcccgggatatgcccctcggtatccctctgtatcgtcatccgatagtagcgcgaggttgcgtaagagtatccgcaagcat

SEQ ID NO: 15026 - RNA, 122 nt, unidentified
  source 1..122: mol_type = other RNA; note = Related to QMFZ01000026.1; note = Burkholderia sp.
cgactcgcggatagattttttgccatgtttcatggcatgtgaagcaaatgttccgagatatgccctcggtatccctctgatactgcagatgcgcgccgatgcgtaggagtatccgcgagtct

SEQ ID NO: 15027 - RNA, 129 nt, unidentified
  source 1..129: mol_type = other RNA; note = Related to JAAOZT010000003.1; note = Glaciimonas immobilis
ggattcgcggatagattttttgccatgtttcatggcatgtgaaatgaatgtcccgggatatgccctcggtatccctctattaccgctatgatgcgcttgctatgttcgcataggagtatccgcgaattt

SEQ ID NO: 15028 - RNA, 129 nt, unidentified
  source 1..129: mol_type = other RNA; note = Related to NZ_JXQM01000003.1; note = Nitrosospira sp.
ggattcacggatagattttttgccatgtatcatggtatgtgaaacaaatgttccaggatatgctcctcggtatccctctgtaatactcgcagttcgcctggtgtaacgcataggagtatccgtgaatcc

SEQ ID NO: 15029 - RNA, 129 nt, unidentified
  source 1..129: mol_type = other RNA; note = Related to NCTK01000001.1; note = Ralstonia solanacearum
gggctcgcggatagattttttgccatgtttcatggcatgtgaaaataatgttacgagatatgccctcggataccctctatgcggcgccatgaagggccggctacgatgcgtaggagtatccgtgagccc

SEQ ID NO: 15030 - RNA, 137 nt, unidentified
  source 1..137: mol_type = other RNA; note = Related to JAJTWU010000005.1; note = Pelomonas sp.
ggactcgcggacagattttttgccatgcttcatggcatgtgaaacaaatgtccggggatatgctcctcggcgtccctcggtgttgcccggcatctcgctgagcaactgtgcggtcgcgtaagagtgtccgtgggtcc

SEQ ID NO: 15031 - RNA, 137 nt, unidentified
  source 1..137: mol_type = other RNA; note = Related to JAGREY010000320.1; note = Ottowia sp.
ggattcacggacagattttttgccatgcttcgtggtatgtgaaacacaggtccggggatatgctcctcggtgcccctcgaggttgccctgcgtcttgctgagcaactgtgcgatcgcgtaagagtgtccgtgggtcc

SEQ ID NO: 15032 - RNA, 136 nt, unidentified
  source 1..136: mol_type = other RNA; note = Related to WSYX01000004.1; note = Ralstonia solanacearum
ggactcacggacagattttttgccatgtttcatggcatgtgaaaagaatgtccggggatatgctcctcggcgtccctcgtgctgagctgcgagaagttgagcatctcggcgtccgcgtaagagtgtccgtgggtcc

SEQ ID NO: 15033 - RNA, 127 nt, unidentified
  source 1..127: mol_type = other RNA; note = Related to NZ_CP034395.1; note = Herbaspirillum seropedicae
cgactcgcggatagattttttaccatggttcatggtatgtgaaataaatgtctggaaatatgccctcggatgccctctatactgatatcgatagagtagcggattgcataagagtatccgcgagtct

SEQ ID NO: 15034 - RNA, 128 nt, unidentified
  source 1..128: mol_type = other RNA; note = Related to JAJFMU010000006.1; note = Xanthomonas campestris
ggactcgcggacagattttttgccatcgattcatggcatgtgaaatgaatgtctctagatatgccctcggatgttcctctgctggacgtacgtggtgcatggttgcgccagggagtgtccgcgagtcc

SEQ ID NO: 15035 - RNA, 128 nt, unidentified
  source 1..128: mol_type = other RNA; note = Related to FLTX01000075.1; note = Xanthomonas bromi
ggactcgcggacagattttttgccatcgcttcatggcatgtgaaaaaaatgtctcgagatatgccctcggatgtccctctgtcgtacgtacgtggtgcatggttgcgccagggagtgtccgcgagtcc

SEQ ID NO: 15036 - RNA, 126 nt, unidentified
  source 1..126: mol_type = other RNA; note = Related to NZ_CP092971.1; note = Xanthomonas oryzae
ggactcgcggacagattttttgccatcgtttcatggcatgtgaaaaaaatgtctcgagatatgccctcggatatcctctgtagtaagtacgtggtgcaagttgcgccagggagtgtccgcgagtcc

SEQ ID NO: 15037 - RNA, 131 nt, unidentified
  source 1..131: mol_type = other RNA; note = Related to DMZZ01000357.1; note = Comamonadaceae bacterium
ggactcgcaaacagattttttgccatgcttcatggcatgtgaaacaaacgtccgcaggaaatgctcctcggtgttcctcgccattcggccacgcgcgatccttgcgttcgcgtaggagtgtttgcgagtcc

SEQ ID NO: 15038 - RNA, 131 nt, unidentified
  source 1..131: mol_type = other RNA; note = Related to NZ_BCWR01000008.1; note = Hydrogenophaga taeniospiralis
ggactcgcagacagattttttgccatgcttcatggcatgtgaaacaaacgtccgcaggaaatgctcctcggtgttcctcgccattcggctactcgcgatcattgcgttcgcgtaggagtgtttgcgagtcc

SEQ ID NO: 15039 - RNA, 133 nt, unidentified
  source 1..133: mol_type = other RNA; note = Related to NZ_CP019236.1; note = Rhodoferax sp.
ggactcgcagacagattttttgccatgattcatggcatgtgaaagaaatgtccccgggaaatgctcctcggtatcctcgccgtattgcggcaatgcgcgtcccctgcgttcgcgtaagagtgtctgcgagtcc

SEQ ID NO: 15040 - RNA, 128 nt, Achromobacter sp.
  source 1..128: mol_type = other RNA; note = Related to CADIKS010000002.1; note = Achromobacter mucicolens
ttgcttgcgggcagaatttttgccatgtttcatggcaaaggaagggaacgttcgggatatatgccctcgtcgtactctattactccataatcatagcgttatcctgcttaaagagtgcccgcaagccc

SEQ ID NO: 15041 - RNA, 131 nt, unidentified
  source 1..131: mol_type = other RNA; note = Related to NZ_CXOO01000052.1; note = Limnohabitans sp.
ggaccggtcagcagaccttttgccgcgcctatcgcggtatgtgaaaaaaatgtgtggggctatgcccctacgcttccttacgttacgccctctcggttactctgcgttggcgtatgagtgctgtccggtcc

SEQ ID NO: 15042 - RNA, 131 nt, unidentified
  source 1..131: mol_type = other RNA; note = Related to NZ_LOJI01000040.1; note = Polynucleobacter yangtzensis
gaacctacaaatagaccttttgtcgtagattcgcgacatgtgaagtaaatgggtggggctatgcctcgtccgtaatcttttcttagttaactgtgcgtactaatgcgtcgcatatgagtatttgtaggttc

SEQ ID NO: 15043 - RNA, 137 nt, unidentified
  source 1..137: mol_type = other RNA; note = Related to NZ_AFWT01000016.1; note = Thiorhodococcus sp.
gggtctatagtcagaatttgtgccatgtcatcgtggtacgtgaaagccaatgtgcggggctatgctggcaccgccgtccttgttgctgaggcatgatgctaagctccttgtttacgcaaaagagtgtctatagaccc

SEQ ID NO: 15044 - RNA, 126 nt, unidentified
  source 1..126: mol_type = other RNA; note = Related to NZ_BCTR01000096.1; note = Sphingomonas azotifigens
aggctcgcggacagattttttgtcgcgtttcgcgacacgtgaagagaatgtgcgggagaattgctcctgcggtccatatgggcaatccctgagggtctacgcctgcgaaggagtgtccgcgagccg

SEQ ID NO: 15045 - RNA, 126 nt, unidentified
  source 1..126: mol_type = other RNA; note = Related to NZ_WOTA01000025.1; note = Acetobacter oeni
tggctcgcggacagattttttgtcgcgcttcgcgacacgtgaaaagaatgtgcgggagaattgctcctgcggtcatttcggcaatcccttagggccttcagcttgcgaaggagtgtccgcgagcca

SEQ ID NO: 15046 - RNA, 127 nt, unidentified
  source 1..127: mol_type = other RNA; note = Related to NZ_JAKREV010000015.1; note = Sphingomonas hankookensis
tggctcgcggacagattttttgtcgcgtttcgcgacacgtgaaaagaatgtgcgggagaattgctcctgcggtccatatgggcaatctctgagggccttacgcctgcgaaggagtgtccgcgagccg

SEQ ID NO: 15047 - RNA, 127 nt, unidentified
  source 1..127: mol_type = other RNA; note = Related to JACTGR010000001.1; note = Sphingomonas sp.
aggctcgcggacagattttttgtcgcgcttcgcgacacgtgaaaagaatgtgcgggagaattgctcctgcggtccattcgggcaatccctatgggtctttcgactgcgaaggagtgtccgcgagcca

SEQ ID NO: 15048 - RNA, 126 nt, unidentified
  source 1..126: mol_type = other RNA; note = Related to NZ_LR733875.1; note = Sphingomonas sp.
gggcttataggcagattttttatcgtgcttcgcgatacgtgaaactattgtccgagggattgctctggacgtgccttaatgtgcaatctttatgcgctatggctgcatacgagtgcctataagccc

SEQ ID NO: 15049 - RNA, 137 nt, unidentified
  source 1..137: mol_type = other RNA; note = Sinobacteraceae bacterium; note = Related to SCRQ01000059.1
aggcgggctggcagagtctgtgccatgtttcgtggcatgtgccaacaatgttgaaccctatgctcctatacctacacgtgaatccacgtgaccgggtatcggtgatgtgctgatcgcgaaagagtgccagcccgccg

SEQ ID NO: 15050 - RNA, 132 nt, Pseudomonas sp.
  source 1..132: mol_type = other RNA; note = Related to AP019411.1; note = Pseudomonas syringae
aggcttacaggcagattttttgccgcgtttcgtcggcatttgaaaccatcgtgtcggagattgcttcgacgtgactcacaatttggcgcttcggaataccctgccgggacgcatatgagtgcctgtaagctt

SEQ ID NO: 15051 - RNA, 131 nt, Pseudomonas sp.
  source 1..131: mol_type = other RNA; note = Related to NZ_CP060289.1; note = Pseudomonas protegens
aagcttacaggcagattttttgccgcgtttcgcggcatttgaaaccatcgtgtcggagattgcttctacgcgactcacaacttggcgcttcggaataccctgccgggacgcatatgagtgcctgtaagctt

SEQ ID NO: 15052 - RNA, 131 nt, Pseudomonas sp.
  source 1..131: mol_type = other RNA; note = Related to NZ_FYDY01000001.1
aagcttacaggcagattttttgccgcgtttcgcggcatttgaaaccatcgtgtcggagattgctcctacgcgactcacaagttggcggttcggaataccctgccgggacgcatttgagtgcctgtaagctt

SEQ ID NO: 15053 - RNA, 133 nt, Pseudomonas sp.
  source 1..133: mol_type = other RNA; note = Related to NZ_CP021132.1; note = Pseudomonas fragi
aagcttacaggcagattttttgtcgcggttcgcgacatttgaaactatcgtggcggacattgctccttcgcgactcacaactgggcggttcaggagtttccctgtcgggacgcatatgagtgcctgtaagctt

SEQ ID NO: 15054 - RNA, 131 nt, Pseudomonas sp.
  source 1..131: mol_type = other RNA; note = Related to JACYWS010000004.1; note = Pseudomonas syringae
aggcctacaggcagattttttaccacggatcgtggtatgtgaacctatcgtgtcggacattgctcctatgcgactcacaatggacgcgggatggaatctcctgacggacgcgtatgagtgcctgtaggccg

SEQ ID NO: 15055 - RNA, 133 nt, Pseudomonas fluorescens
  source 1..133: mol_type = other RNA; note = Related to CABVHP010000013.1
aggtttacaggcagatttttttaccacggttcgtggtacgtgaaaggttcgtgctggatattgcttctacgcgactcacaaagggatgcagggtgaataatcctgacggacgcatatgagtgcctgtaaacct

SEQ ID NO: 15056 - RNA, 131 nt, Pseudomonas fluorescens
  source 1..131: mol_type = other RNA; note = Related to CABVHX010000009.1
agccttacagacagattttttgccgcggatcgcggcagttgaaactatcgtgtcggagattgcttctacgcgactcacagttttacgccatgatgaatatccggcggacgcatatgagtgtctgtaaggct

SEQ ID NO: 15057 - RNA, 133 nt, Pseudomonas sp.
  source 1..133: mol_type = other RNA; note = Related to NZ_JACAOZ010000012.1; note = Pseudomonas edaphica
aggcctacaggcagattttttgccacggttcgtggcatttgaaacaatcgtgcgggagattgctccttcgcgactcacagtttgacgccaaaatgaataatcctggcggacgcatatgagtgcctgtaagcct

SEQ ID NO: 15058 - RNA, 133 nt, Pseudomonas sp.
  source 1..133: mol_type = other RNA; note = Related to MUHV01000013.1
gagcttacaggcagatttttttgtcgcgtttcgcgacatttgaaaacatcatgtgggggattgcttcctgacgtgactcaacacgttgacgcgaaattcgtgtcggcggacgcatatgagtgcctgtaagcgt

SEQ ID NO: 15059 - RNA, 134 nt, Pseudomonas sp.
  source 1..134: mol_type = other RNA; note = Related to NZ_SOCQ01000001.1; note = Pseudomonas helmanticensis
gagcttacaggcagatttttttgtcgcggttcgcgacatttgaaagtattgcgtgggagattgcttcctatcgtaactctacaagtttgacgcgaagttcgtgtcggcggacgcatatgagtgcctgtaagcgt

SEQ ID NO: 15060 - RNA, 132 nt, Pseudomonas sp.
  source 1..132: mol_type = other RNA; note = Related to CP050147.1; note = Pseudomonas aeruginosa
gagcttacaggcagatttttttgccacggttcgtggcatttgagaaggtcgtgtgggagattgcttctatacgagtcacaagttatgcgctgaaagtgtgtctgacggacgcgtatgagtgcctgtaagcct

SEQ ID NO: 15061 - RNA, 133 nt, Pseudomonas sp.
  source 1..133: mol_type = other RNA; note = Related to QJUQ01000005.1; note = Pseudomonas kirkiae
aggtttatagacagattttttgccatggttcgtggcatttgaaatcattgtgtgggggaatgcttcctcagacttccgcaatctttacgccatgatgactgtctggcggacgcatatgagtgtctataaacct

SEQ ID NO: 15062 - RNA, 133 nt, Pseudomonas sp.
  source 1..133: mol_type = other RNA; note = Related to NZ_CP052862.1
gagcttatagatagattttttgtcatgtttcgtgacatttgcaaatcttgtgtgagtgattgctcatacagttatcagcagtcttggcgccaaagtaaatgtctggcggacgctaatgagtatctataagctc

SEQ ID NO: 15063 - RNA, 136 nt, Pseudomonas fluorescens
  source 1..136: mol_type = other RNA; note = Related to JAGGOG010000003.1
aggcttatagatagatttttggtcgtgtttcgcgatctgtgatacctaatgtcggagtacattgctcctacaattttgcaagctgtttggcgcttcagggttacttgaagtttcgcataagagtatctataagcct

SEQ ID NO: 15064 - RNA, 136 nt, Pseudomonas sp.
  source 1..136: mol_type = other RNA; note = Related to NZ_LT607556.1
aggcttatagatagatttttggtcgtgtttcgcgatctgtgatacctaatgtcggagtacattgctcctacaatttagcaagctgtttggcacttcagggttacttggagtttcgcataagagtatctataagcct

SEQ ID NO: 15065 - RNA, 137 nt, Pseudomonas fluorescens
  source 1..137: mol_type = other RNA; note = Related to NZ_CABVHD010000002.1
aggcttatggatagattttttgtcgtgtttcgcgacatgtgataccaaatgtcggagtacattgctcctgacagactttgcaagcgtgcggttcaaatgggtcgctatgagtttcgcgtaagagtatccataagcct

SEQ ID NO: 15066 - RNA, 137 nt, Pseudomonas sp.
  source 1..137: mol_type = other RNA; note = Related to NZ_UTCV01000055.1; note = Pseudomonas viridiflava
aggcttatggatagattttttgtcgtgtttcgcgacatgtgacatcaaatgtcggagtacattgctcctgacagactttgcaagcgggcgcttcagaagggttcccatgagtttcgcgtaagagtatccataagcct

SEQ ID NO: 15067 - RNA, 127 nt, unidentified
  source 1..127: mol_type = other RNA; note = Related to JAHKPP010000027.1; note = Saccharophagus degradans
tggcttctaggcagattttgtgttgcgtttcgcaacatttgaaaacaacgtcctaaggaattgccctgtgtgacgcctttcgtcattacgctatgcggtgaaacggcgtaagagtgcctagaagcct

SEQ ID NO: 15068 - RNA, 128 nt, Chromobacterium sp.
  source 1..128: mol_type = other RNA; note = Related to NZ_LCWR01000203.1; note = Chromobacterium subtsugae
gggcttgcaaatagatttttttgccatgcttcgtggcaagtgataataatgctgagtggtatagctcagtatctcgttgtattcagtgaatgtatgcgatattccgcataaagagtatttgcaagcct

SEQ ID NO: 15069 - RNA, 129 nt, Chromobacterium sp.
  source 1..129: mol_type = other RNA; note = Related to CP069442.1; note = Chromobacterium violaceum
aggcttgcaaatagatttttttaccgcgtatcgtggtaagtgttaataatgctgagtggtatagctcggtatcttgtgtccaatagggtaatcctgtgcaaattaccgcataagagtatttgcaagccg

SEQ ID NO: 15070 - RNA, 147 nt, unidentified
  source 1..147: mol_type = other RNA; note = Related to NZ_CP031124.1; note = Ephemeroptericola cinctiostellae
agggctatagatagactttttgacgcgctatcgtgtcatgtgaaaaaaatgttgcacagacttattatgctgcattgtttcaaatttattaatttcattttttagtggttgatctttaactacgcaaacaagagtatctatagccca

SEQ ID NO: 15071 - RNA, 124 nt, unidentified
  source 1..124: mol_type = other RNA; note = Related to JAEMNU010000126.1; note = Rugamonas sp.
tggcctataaacagattttttgtcatgattcgtgacaagtatgaataatgtcgctaagtattgccttaatgttcgcccagttgtcctggaatgacgcgctttgcgtaagagtgtttataggcca

SEQ ID NO: 15072 - RNA, 129 nt, unidentified
  source 1..129: mol_type = other RNA; note = Related to NZ_CP009962.1; note = Collimonas arenae
gggcttatagatagattttttgtcatgcatcgtgacacgtgaaataaacgttaggcagcattgcctatgaatatacttagcaatatcctagcggtaaacgttaagctgcataggagtatctataggccc

SEQ ID NO: 15073 - RNA, 134 nt, Pseudomonas sp.
  source 1..134: mol_type = other RNA; note = Related to RHQT01000006.1
gggtttataggcagattttttgtcatgcttctgtgacaagtggcaacaatgttgggcgccaatgctcacatatccctcccagagtggtcgactcgattggtcactgtgattcgcgtaagagtgcctataaaccc

SEQ ID NO: 15074 - RNA, 134 nt, Pseudomonas sp.
  source 1..134: mol_type = other RNA; note = Related to CP066045.1; note = Pseudomonas stutzeri
gggcttatagacagattttttgtcatgcttctgtgacaagtggcaccaatgttggagtccatcgctctaatagttcttctcagaatggtcatctaaggtcatctctggtaacgcgtaagagtgtctataagccc

SEQ ID NO: 15075 - RNA, 130 nt, unidentified
  source 1..130: mol_type = other RNA; note = Related to JAIZSB010000002.1; note = Burkholderia cepacia
ggacttgcggatagattttttgtcatgcttcgtgacacgtgaaataaatggtggagagattgcttatccattatccgctttgcaattactatgcataatgcacctactgcgtaggagtatccgcaggtcc

SEQ ID NO: 15076 - RNA, 129 nt, unidentified
  source 1..129: mol_type = other RNA; note = Related to QTSF01000012.1; note = Burkholderia cenocepacia
ggacttgcggatagattttttgtcatgtttcgtgacacgtgaaataaatggtggagagattgctatccattatccgctttgcaattactatgcataatgcacatactgcataggagtatccgcaggtcc

SEQ ID NO: 15077 - RNA, 130 nt, unidentified
  source 1..130: mol_type = other RNA; note = Related to CABWIJ010000002.1; note = Burkholderia lata
ggacttgcggatagattttttgtcatgtttcgtgacacgtgaagtaaatggtggagagattgcttatccattatccgtttagcaattactatgcataatgcagtaaccgcataggagtatccgcaggtcc

SEQ ID NO: 15078 - RNA, 126 nt, unidentified
  source 1..126: mol_type = other RNA; note = Related to NZ_JMLA01000001.1; note = Methylobacter tundripaludum
gggcttatagacagattttttgtcatgtttcgtgacacgtgaagataaagtttggtgctattgcatccttacgtcccttaggcaattttgggcaatatccctttgcataagagtatctataagccc

SEQ ID NO: 15079 - RNA, 131 nt, unidentified
  source 1..131: mol_type = other RNA; note = Related to NZ_FNKX01000001.1; note = Paraburkholderia tuberum
gggcttgtagacagattttttgtcatgtttcgtgacatgtgaaagcaatgttggggttattgctcctcattattcccattatgcaatttcttagcaaattgcagataccgcataggagtgtctgcaagccc

SEQ ID NO: 15080 - RNA, 127 nt, unidentified
  source 1..127: mol_type = other RNA; note = Related to JACVPK010000006.1; note = Polynucleobacter wuianus
aggtttgtgggtagattttttgtcatgcatcgtgacaagcgttaacaatgtcgggcttattgccctttacttattccttgcaatttctatgcgaaagctactactgcgtaagagtacccacaaacct

SEQ ID NO: 15081 - RNA, 133 nt, unidentified
  source 1..133: mol_type = other RNA; note = Related to PHCU01000169.1; note = Betaproteobacteria bacterium HGW-Betaproteobacteria-12
gggccgttgggcagagtttttgccgttgattcgcggcatgtgacaacaaagtcagaggctttgcccctgatatccgatccaaatgggattcgctggatgatccctatgatgcttaagagtgcctaacgcgccc

SEQ ID NO: 15082 - RNA, 134 nt, unidentified
  source 1..134: mol_type = other RNA; note = Related to NCCT01000010.1; note = Hydrogenophilales bacterium 12-61-10
gggccgttgggcagagtttttgccgttgtttcgcggcatgtgacaacaatgtcagtggctttgcctcctgatgtccgatgtaaatgggatcagcttaatgatctccgtaatgctaaagagtgcctaacgtgccc

SEQ ID NO: 15083 - RNA, 132 nt, unidentified
  source 1..132: mol_type = other RNA; note = Candidatus Accumulibacter sp.; note = Related to JAGFNH010000001.1
gggccgttgggcagagtttttgccgttgattcgcggcatgtgacaacaaagtcaggggctttgccgcctgatatccgttagatggcccgctgatgtggtccatagtagtgcttaagagtgcctaacgcgccc

SEQ ID NO: 15084 - RNA, 138 nt, unidentified
  source 1..138: mol_type = other RNA; note = Related to JAIQFH010000036.1; note = Acidobacteriia bacterium
gtgcctacagtcagatcttttgctgcgtatcgtggcacgtgacaacaatgtcagatggattgcttgcacgtcgcattgcgcgaccgtatctgactctatcgcactatgtagctatcgcgtaagagtgactgtaggcat

SEQ ID NO: 15085 - RNA, 134 nt, unidentified
  source 1..134: mol_type = other RNA; note = Related to JAIQFA010000126.1; note = Acidobacteriia bacterium
ccgcctacagtcagatcttttgccgcgttatcgtggcacgtgacaacaatgtcagttgctttgctggcacatcgctcgacgctactcgatttgccatcgaactatagctctcgcgtaagagtggctgtaggcat

SEQ ID NO: 15086 - RNA, 139 nt, Pseudomonas sp.
  source 1..139: mol_type = other RNA; note = Related to NRAO01000002.1; note = Pseudomonas aeruginosa
gggcttatagcagattttttatcgtgtttcgcgatatgtgacatcaatggtaggcagtattgctatcctcagcggcaacctaacgctatcgacgactcgtggtccacgttagcgttcgcgttatgagtgctataagctc

SEQ ID NO: 15087 - RNA, 133 nt, Pseudomonas sp.
  source 1..133: mol_type = other RNA; note = Related to CP068986.1
gggcttgtagacagatcgttttatcgcgaatcgcgataagtgacatcaacggtggtaggtattgccattacattacttcgcaatctcacgcggagagactcattgacacttgcatatgagtgtctacaagccc

SEQ ID NO: 15088 - RNA, 131 nt, Pseudomonas sp.
  source 1..131: mol_type = other RNA; note = Related to NZ_CP065202.1; note = Pseudomonas fragi
gggcttatagacagatcttttatcgcgtatcgcgatatgtgacatcaacggtagtagttgattgctaccgaacgttactgaagtctcaacccgaagactctcggcgtttgcaaatgagtgtctataagccc

SEQ ID NO: 15089 - RNA, 132 nt, Pseudomonas sp.
  source 1..132: mol_type = other RNA; note = Related to JAHUWE010000017.1
gggtttatagacagattttttatcgcgaatcgcgatatgtgacatcaacggtagtatgcattgctacttaacgttactcgaagtctcaaactgaggcacattggcaggttgcaaatgagtgtctataaaccc

SEQ ID NO: 15090 - RNA, 125 nt, unidentified
  source 1..125: mol_type = other RNA; note = Related to CP028127.1; note = Xanthomonas vasicola
ggggttgcaggaagatttggttgccgtagtctcgcggcatcagaaacgattgcaaggtgaatttgccgattggcgcgagtgcagcaatacgctcgccatgcgtgcgaaggagttcctgcaacccc

SEQ ID NO: 15091 - RNA, 125 nt, unidentified
  source 1..125: mol_type = other RNA; note = Related to NZ_CP064002.1; note = Xanthomonas translucens
ggggttgcaggaagatttggttgccgtcgtttcgcggcatcagaagcaattgcaaggtggatttgccgaatggaccgagtgccgacatacgctcgccatgcgcgcgaaggagttcctgcagcccc

SEQ ID NO: 15092 - RNA, 125 nt, unidentified
  source 1..125: mol_type = other RNA; note = Related to NZ_NSGT01000016.1; note = Xanthomonas sp.
ggggttgcaggaagatttggttgccgtagtttcgcggcttcagaaaaaattgcaaggtggatttgccgaatggcgcgagggcagctacgcgctcgcgacgcgtgcgaaggagttcctgcaacccc

SEQ ID NO: 15093 - RNA, 125 nt, unidentified
  source 1..125: mol_type = other RNA; note = Related to JAJA02000003.1; note = Lysobacter capsici
ggggctgcaggaagatttggttgccgtagtttcgcggcatcagaaacaattgcagcgtggatttgcctaatggctcgactgcagcgatacgctcgctgtgcgtgccaatgagttcctgcagcccc

SEQ ID NO: 15094 - RNA, 125 nt, unidentified
  source 1..125: mol_type = other RNA; note = Related to FOAX01000001.1; note = Pseudoxanthomonas sp.
ggggttgcaggaagatttggttgtcgcgtttcgcggcatcagaaacaattgcaagaaagatttgccggttggcgctgagtgcagctcggcgcgcgctgggcgtgcgaaggagttcctgcaacccc

SEQ ID NO: 15095 - RNA, 124 nt, unidentified
  source 1..124: mol_type = other RNA; note = Related to JAIWPR010000054.1; note = Luteimonas sp.
ggggttgcaggaagatttggttgccaccgaatcgtggcatcagaaccaattgcacgatcgatttgccgagtggcgctgagtgcaactgtgcgcgactggctagcgagggagttcctgcaacccc

SEQ ID NO: 15096 - RNA, 126 nt, unidentified
  source 1..126: mol_type = other RNA; note = Related to CP018725.1; note = Xanthomonas vesicatoria
ggggttgcaggaagatttggttgccgtcgtatcgcggcatcagaagaaattgcaggatggatttgcccggtggcgctgagtgcagcttggcgctcgcctcgcgtgcgagagagttcctgtaacccc

SEQ ID NO: 15097 - RNA, 126 nt, unidentified
  source 1..126: mol_type = other RNA; note = Related to CP011130.1; note = Lysobacter capsici
ggggttgcaggaagatttggttgccgccgaatcgcggcatcagaagcaattgcaagatggatttgcccggtgacgctgagtgcaactcggcgctcgcttggcgtgcgagagagttcctgcaacccc

SEQ ID NO: 15098 - RNA, 126 nt, unidentified
  source 1..126: mol_type = other RNA; note = Related to JACVAG010000008.1; note = Pseudoxanthomonas sp.
ggggttgcaggaagatttggtcgccgccgtttcgcggcatcagaaacaattactggatggatttgccccgatggcgcggattgcagcgcagcggtcgcatgttagctaaagagttcctgcaaccct

SEQ ID NO: 15099 - RNA, 129 nt, unidentified
  source 1..129: mol_type = other RNA; note = Related to JAHCAU010000005.1; note = Lysobacter sp.
ggggttgcaggaagatttggttgccgacgtttcgcggcatcagaagtcattgtccgctggatttgccccggttagcacgagtgcagcgtatcgcgctcgcatcgcttgcgaaggagttcctgcaaccct

SEQ ID NO: 15100 - RNA, 126 nt, unidentified
  source 1..126: mol_type = other RNA; note = Related to NZ_CP018756.1; note = Stenotrophomonas maltophilia
ggggctgcaggtagatccttttgtcgtggtttctgcgacatacgaaacaattgttggttggattgctccgagtggcaccgttgcggcgtccgtcgcgcgcaatagcgagtgagtacctgcagcccc

SEQ ID NO: 15101 - RNA, 125 nt, unidentified
  source 1..125: mol_type = other RNA; note = Related to NZ_WVHR01000032.1; note = Paraburkholderia madseniana
ctgtctgcggacagatttgttatcgcgattcgcgataaatggaagtaatgtgcgaaggcgctgccctcgcatctcgtagcggctatctcgccgatgatacgttgccaaagagtgtccgcagacac

SEQ ID NO: 15102 - RNA, 125 nt, unidentified
  source 1..125: mol_type = other RNA; note = Related to NZ_QLTK01000030.1; note = Paraburkholderia bryophila
ctgtctgcggacagatttgttatcgcgattcgcgataaatggaagtaatgcgcgaaggcgctgccctcgcatatcgtagcggctatctcgctgatgatacgttgccaaagagtgtccgcagacac

SEQ ID NO: 15103 - RNA, 123 nt, unidentified
  source 1..123: mol_type = other RNA; note = Related to JAAGPR010000055.1; note = Paraburkholderia sp.
tcgtctgcggacagatttgttatcgtgtttcgcgataaatggacgtatcgttaggcgacgttgccctcgcatatcgtagcatccgccatgagatgagccttgccatagagtgtccgcagacat

SEQ ID NO: 15104 - RNA, 123 nt, unidentified
  source 1..123: mol_type = other RNA; note = Related to NZ_JZUR01000039.1; note = Burkholderia vietnamiensis
cggcctacggacagatttattgtcgtgcttcgcgacaaatggaagtcatgtgggggggtgttgccctcgcctatccttagcatccgctatgaatgatgcgtgccaaagagtgtccgtaggcat

SEQ ID NO: 15105 - RNA, 125 nt, unidentified
  source 1..125: mol_type = other RNA; note = Related to NZ_LT977071.1; note = Cupriavidus taiwanensis
gggcctgcggatagatttattgtcgtgtttcgcgacaggtggaagtcatgcaagggaagattgcctttgcgtcaatgtagcaatgtgccgtgaatcgtcgctgccagagagtgtccgtagcgccc

SEQ ID NO: 15106 - RNA, 124 nt, unidentified
  source 1..124: mol_type = other RNA; note = Related to JAFEDJ010000026.1; note = Proteobacteria bacterium
gggcctacggatagatttattgtcgtgcttcgcgacagatggaagtcatgtatgggtagattgcccttgcgtcgtcgtagcaatatgtcggcgatgtagctgccaaagagtatccgtagcgccc

SEQ ID NO: 15107 - RNA, 133 nt, unidentified
  source 1..133: mol_type = other RNA; note = Related to NZ_JAJJOZ010000002.1; note = Paracandidimonas sp.
tggcccgtagacagagtttctgccatgtaatcgtggcacttgacaataacgtgaggacctatgctcctcagtccataatgccttacgcgacttgagtgttggcaatatttgcatttgagtgtctacgtggccg

SEQ ID NO: 15108 - RNA, 130 nt, unidentified
  source 1..130: mol_type = other RNA; note = Related to NZ_JACJUU010000033.1; note = Pusillimonas minor
ggcctcgtagacagagtttctgccgtgtgatcgtggcacttgacaataatgtgaggagctatgctcctatcaataacgcttagcacgattatagtgttagcaatgtttgcttttgagtgtctacttggcc

SEQ ID NO: 15109 - RNA, 135 nt, unidentified
  source 1..135: mol_type = other RNA; note = Gammaproteobacteria bacterium; note = Related to JAHJHQ010000474.1
ggcctcgtagacagactttctgccatgtgatcgtggcacttgacaaaaatgtgaggacctatgccctcctaccaccatgcggctcatcttttaatgatgctgatcgcgatgtagcaatggagtgtttacggggcc

SEQ ID NO: 15110 - RNA, 137 nt, unidentified
  source 1..137: mol_type = other RNA; note = Related to NZ_MCAS01000001.1; note = Paraburkholderia fungorum
ggtctcgcagacagaatttctgccatgtaatcgtggcacttggcaacaatgtgaggacctatgccctcgtatgcacctgacgaggagacgatgacctgtacgatatcgccgcttggcgattgagtgtctgcgaggcc

SEQ ID NO: 15111 - RNA, 136 nt, unidentified
  source 1..136: mol_type = other RNA; note = Related to FSRU01000001.1; note = Paraburkholderia phenazinium
ggcttcgcagacagagtttctgccatgtaatcgtggcacttgacaacaaagtgaggacctatgctgctcctcggctactacgcctgacggaactttccgttcatatgatcgatcgcgttggagtgtctgcgaggcc

SEQ ID NO: 15112 - RNA, 135 nt, unidentified
  source 1..135: mol_type = other RNA; note = Related to NZ_LOVK01000019.1; note = Burkholderia ubonensis
ggcttcgcggacagagtttctgccatgtaatcgtggcacttgacaacaatgtgaggacctatgctgctcctcggctactacgccggacggaatttccgttcatatgatcgatcgcgttggagtgtccgcgaggcc

SEQ ID NO: 15113 - RNA, 135 nt, unidentified
  source 1..135: mol_type = other RNA; note = Related to NZ_CABPSB010000021.1; note = Pandoraea anhela
cgcctcgtagacagaatttctaccatgaatcatggcacttggcaataatgttaggacctatgctgctatcgatatcaaccggattggcgccataacgatgtagcgttcaatgcgcgttggagtgtctacgaggca

SEQ ID NO: 15114 - RNA, 133 nt, unidentified
  source 1..133: mol_type = other RNA; note = Related to NZ_CABPSK010000001.1; note = Pandoraea pneumonica
cgcctcgtagacagaatttctgccatgaatcatggcacttgacaacaatgttaggacctatgctgcatcgatatcaacctgattggcgccatgtggagcaggagccaatacgcgttggagtgtctacggggct

SEQ ID NO: 15115 - RNA, 134 nt, unidentified
  source 1..134: mol_type = other RNA; note = Related to NZ_LT984806.1; note = Cupriavidus sp.
cgccccgtaggcagaatttctgccatgaatcatggcacttggtaacaaagttaggacctatgctgcatcgatatcaaccgtaatgacgccatgctgagattgcggccaattcgcgttggagtgtctacggggtt

SEQ ID NO: 15116 - RNA, 134 nt, unidentified
  source 1..134: mol_type = other RNA; note = Related to WSNR01000001.1; note = Ralstonia solanacearum
tgccccgtagacagaatttctgccatgaatcatggcatttggcaacaatgttaggacctatgctgcatcgggtatcatccgacggacgccatgcgtagctcgtggccaattcgcgatggagtgtctacggggcc

SEQ ID NO: 15117 - RNA, 133 nt, unidentified
  source 1..133: mol_type = other RNA; note = Related to CP028290.1; note = Acidovorax cattleyae
ggctccgtagacagactttctgccatgtatcgtggcacttgacaacaacgtgagggcctatgcctcatccttatgaatcgacacagcgtatttgtatgtgacgattggttcgcgtaagagtgtctgcggagcc

SEQ ID NO: 15118 - RNA, 129 nt, unidentified
  source 1..129: mol_type = other RNA; note = Related to NZ_JACBGE010000023.1; note = Hydrogenophaga sp.
ggagcctcaggaagaattttttggcctgtatcgggctgagtgaaatcaacgttgggtggattgctcccggcgtatcttccagtattcatcgctgtcaatctgcgatgcctaatgagttcctggggctcc

SEQ ID NO: 15119 - RNA, 129 nt, unidentified
  source 1..129: mol_type = other RNA; note = Related to MRCN01000005.1; note = Variovorax boronicumulans
ggacacccaggaagatttttcggcccgcatcgggtcgtgtgaagacaaggtccggcaggttgcccctacgtctatctcatcgcttagcaccttctcatcttacgatgcagaatgagttcctgggtggcc

SEQ ID NO: 15120 - RNA, 133 nt, Achromobacter sp.
  source 1..133: mol_type = other RNA; note = Related to JADCNH010000007.1
ggccccgcaaacagatttttttgtcgtgtttcgcggcaagtgaacgaaatgtttccgggtatgctccatgtcggctaactggttatcgtacagctgatgtatgctcatcaagccaatgagtgtttgtggggcc

SEQ ID NO: 15121 - RNA, 142 nt, unidentified
  source 1..142: mol_type = other RNA; note = Related to NC_020813.1; note = Pseudobdellovibrio exovorus
tggtctatgggtagactttgtgctgcggatcgcagcatttgatgaattgtcatcaagtgtcttatttactctacgagtgtctaaccgtatagtctctttcgcttggctttagtgtatgttggtaaagagtacccatagacca

SEQ ID NO: 15122 - RNA, 129 nt, unidentified
  source 1..129: mol_type = other RNA; note = Related to NZ_JADPQF010000006.1; note = Aliikangiella sp.
ttgcctaggggtagaattttacatcgcgaatcgcgatgcgagataataatggtaggcagattgccactcgaatagtcattccgatgagctattggtcgcatgagactgcaaaggagtacccctaggttt

SEQ ID NO: 15123 - RNA, 146 nt, unidentified
  source 1..146: mol_type = other RNA; note = Related to NZ_QJSU01000001.1; note = Psychrobacter fozii
agacctataaatagattttatcattgtgcttcacaatgagtgattttcaagctactactccttttaagctcatgaggttctatgaggctcttggtttgtcgtagggttcctagtgtattatattgcgaaagagtatttataggtct

SEQ ID NO: 15124 - RNA, 126 nt, unidentified
  source 1..126: mol_type = other RNA; note = Related to NZ_BMXO01000001.1; note = Halomonas johnsoniae
ttgcttgcagacagatttttttgtcatgcttcgtgacaggtgaaatcaatgttaggggctttgccatttagcattccttgacggtagcgatgctacctgaacgcgcataagagtgtctgcaagcat

SEQ ID NO: 15125 - RNA, 130 nt, unidentified
  source 1..130: mol_type = other RNA; note = Related to NZ_JACTAG010000001.1; note = Sulfitobacter aestuariivivens
tagcttgcggatagatctttccgctgtggttcgcagcgggtgaaaaaattgttcggaggaattgctccttcgtcatctttgcaacattgttggaaatccgtgggtttgctcaacgagtatccgcaagcga

SEQ ID NO: 15126 - RNA, 128 nt, unidentified
  source 1..128: mol_type = other RNA; note = Related to NZ_FOPM01000016.1; note = Methylobacterium gossipiicola
aggcttgcaggcagattcgttgttatgtttcgtaacaagtaatataaatggcgggggcatcgccttcgcgactcgtgatcctggtgaccttgactgtcatcctgcgcatagagagtgcctgcaagctt

SEQ ID NO: 15127 - RNA, 129 nt, unidentified
  source 1..129: mol_type = other RNA; note = Related to JAKSXV010000098.1; note = Methylobacterium sp.
gggcttgtaggcagattcgttgctatgtttcgtagcaagtaacataaatggcgggggcatcgcctccgtgactcgtggcttcgatgaccttcgactgtcatcctgtgcatagagagtgcctacaagccc

SEQ ID NO: 15128 - RNA, 128 nt, unidentified
  source 1..128: mol_type = other RNA; note = Related to QYRN01000007.1; note = Aureimonas flava
cggtttacaggcagatccgttgttgtgtttcgcaacaagtaacataaaagtctcccgcattgcctcagcatctggcgatcacgacgggtcgatgggtcctggggtgcatagagagtgcctgtaaaccg

SEQ ID NO: 15129 - RNA, 136 nt, unidentified
  source 1..136: mol_type = other RNA; note = Related to JAFUJV010000004.1; note = Treponema sp.
tgccctataagtagattttattattgtgtttcgcaatatttgaagaaaatactgcatgaggtttctcggctattttcgttctatgtttcagattagacagacagaagatctatcgccaaagagtacttatagggct

SEQ ID NO: 15130 - RNA, 127 nt, Salmonella sp.
  source 1..127: mol_type = other RNA; note = Related to AANPCH010000002.1; note = Salmonella bongori
gggcctatagatagattttgtatcatgtttcgtgatatgtgaaaaaaatgttagaggcaacgccctaagtatgctttacgccagaggtaaatgcctcacgctatgctaaagagtttctatagtgccc

SEQ ID NO: 15131 - RNA, 127 nt, Salmonella sp.
  source 1..127: mol_type = other RNA; note = Related to CP074306.1; note = Salmonella enterica
gggcctatagatagattttgtatcatgtttcgtgatatgtggaaaaaatgttagaggcaacgcccctagtatgctttacgccagagggaaatacctcacgctgtgctaaagagtttctatagtgccc

SEQ ID NO: 15132 - RNA, 125 nt, unidentified
  source 1..125: mol_type = other RNA; note = Related to NZ_LT615367.1; note = Dickeya aquatica
gggcctatagaaagattttgtatcatgtttcgtgatatgtgaaaaaaaagttagaggcaacgccttaagtatgctcggtcatgaggaactacctcacgccctgctaaagagtttctatagtgccc

SEQ ID NO: 15133 - RNA, 141 nt, unidentified
  source 1..141: mol_type = other RNA; note = Related to JAGGMP010000001.1; note = Erwinia rhapontici
gtgcccatagttagattttgtgtcatgtttcatgacaagtgaaaagaacgttggagccaacgctccttgaagtatccttaaagagtaacatggatagccgccaagttactcgtcgaatcgcgtaagagtaactatgggcac

SEQ ID NO: 15134 - RNA, 139 nt, unidentified
  source 1..139: mol_type = other RNA; note = Related to NZ_NRNL01000028.1; note = Cronobacter malonaticus
ctgcccatagttagattttgtgtcatgtttcgtgacaagtgaaaacaaggttggagccaacgctccctgaatatccttactgagtgacacggatttccgccagtcccccagccaatcgcgtaagagtaactatgggcac

SEQ ID NO: 15135 - RNA, 140 nt, unidentified
  source 1..140: mol_type = other RNA; note = Related to SZZV01000010.1; note = Pantoea sp.
tcgcccacagttagattttgtgtcatgtttcgtgacaagtgataacaacgttggagccaacgctgctctaatggcgtcaaagaggtacagggggaaacgctaagttgctcccaatatcgcataagagtaactgtgggcac

SEQ ID NO: 15136 - RNA, 129 nt, unidentified
  source 1..129: mol_type = other RNA; note = Related to NSDJ01000002.1; note = Rahnella variigena
tggtctataaacagattttgtgtcgcgtatcgcgataagtgaaagtaaggttggagacaaccgccgcgttgaaataatatggccaccggtgggtcgccgtatgagtgcgataagagtgtttatagaccc

SEQ ID NO: 15137 - RNA, 130 nt, unidentified
  source 1..130: mol_type = other RNA; note = Related to NZ_CAKLIS010000018.1; note = Pectobacterium versatile
tggtctataaacagattttgtgtcgcgaatcgcgataagtgaaaaaaaggttggagacaaccgccccattgaaaacgtgacggcaccgccagtgtgcatactcgaatgcgttaagagtgtttatagacca

SEQ ID NO: 15138 - RNA, 135 nt, unidentified
  source 1..135: mol_type = other RNA; note = Related to NZ_JAFBFW010000001.1; note = Pantoea coffeiphila
tggtttatgggcagattttgggtcgcgtttcgcgatcagtgaaaaaaatgtccggtaggattgccctttcaggaactcattgtcctggcgcttcttaggttcttgtcaagtttgcgtaagagtgcccataaacct

SEQ ID NO: 15139 - RNA, 134 nt, unidentified
  source 1..134: mol_type = other RNA; note = Related to AP025009.1; note = Raoultella ornithinolytica
cggtttatgggcagattttgggtcgcgtttcgcgatcagtgaaaaaaatgtccgataggattgcctttcaggaactcattgtcctggcgtttcttgaattcttgtcaagtttgcgtaagagtgcccataaacca

SEQ ID NO: 15140 - RNA, 134 nt, unidentified
  source 1..134: mol_type = other RNA; note = Related to LMLK01000003.1; note = Erwinia sp.
tggtttatgggcagattttggatcgcgtttcgcgatcagtgaaaaaaatgtccgattggattgcctctcagggtctcactttcctggctttacctgacttcttgtcaagtttgcgtaagagtgcccataaacca

SEQ ID NO: 15141 - RNA, 135 nt, unidentified
  source 1..135: mol_type = other RNA; note = Related to CP071802.1; note = Yersinia ruckeri
tggtttatgggcagattttggatcgcgtttcgcgatcagtgaaaaaaatgtccgataggattgcctttcagggtctcacgttctccgcgctactcgaggttcttgtcaagtttgcgtaagagtgcccataaacca

SEQ ID NO: 15142 - RNA, 135 nt, Escherichia coli
  source 1..135: mol_type = other RNA; note = Related to NZ_CP080146.1
tggtttatgggcagattttgggtcgcgtttcgcgatcagtgaaaaaaatgtccgataggattgcctttcaggatctcatgttcctcgcatttcttaaggttcttgtcaagtttgcgtaagagtgcccataaaccc

SEQ ID NO: 15143 - RNA, 135 nt, unidentified
  source 1..135: mol_type = other RNA; note = Related to NZ_CP065024.1; note = Rahnella inusitata
tggtttatgggcagattttggatcgcgtttcgcgatcagtgaaaaaaatgtccaataggattgcctttcaggggctcacgttcctggcgttactcgacggtcttgtcaagtttgcgtaagagtgcccataaacca

SEQ ID NO: 15144 - RNA, 136 nt, Vibrio parahaemolyticus
  source 1..136: mol_type = other RNA; note = Related to LQCW01000011.1
tggtttatgggcagattttggttcgcgtttcgcgatcagtgaaaaaaatgtccgactggattgcctttcaggttctcacgtttccggacgctcttttaacttcttgtcaagtttgcgtaggagtgcccataaacca

SEQ ID NO: 15145 - RNA, 137 nt, Vibrio sp.
  source 1..137: mol_type = other RNA; note = Related to KB662759.1; note = Vibrio cholerae
cggtttatgggcagattttgggtcgcgtttcgcgatcagtgaaaaaaatgtccgataggattgccttttcaggttctcatgtttccggatgctcttttaacttcttgtcaagtttgcgtaggagtgcccataaacca

SEQ ID NO: 15146 - RNA, 135 nt, Vibrio parahaemolyticus
  source 1..135: mol_type = other RNA; note = Related to JACBSO010000017.1
cggtttatgggcagactttgggtcgcgtttcgcgatcagtgaaaaaaatgtccgagtggtttgccttgtgtagctcattgtaccggatgctctttgaacttcttgtcaagtttgcgtaggagtgcccataaacca

SEQ ID NO: 15147 - RNA, 134 nt, Aeromonas sp.
  source 1..134: mol_type = other RNA; note = Related to JAKZFL010000005.1
aggtttatgggcagatattggatcgcgcttcgcgatcagtgaaaaaaacgtccgaaaggattgcccgaaggtatcacgttgtcagacgctctccgtagttcttgtcacgtttgcgtaggagtgcccataaacca

SEQ ID NO: 15148 - RNA, 134 nt, Aeromonas salmonicida
  source 1..134: mol_type = other RNA; note = Related to QLLM01000001.1
tggtttatgggcagatttttgatcgcgcttcgcgattagtgaaaacaatgtccgaaaggattgccattttgatatcaaattgtcagagctctccgtagttcttgtcaagtttgcgtaggagtgcccataaacca

SEQ ID NO: 15149 - RNA, 134 nt, Vibrio sp.
  source 1..134: mol_type = other RNA; note = Related to POSH01000027.1; note = Vibrio diazotrophicus
tggtttatgggcagattttggatcgcgtttcgcgatcagtgaaaataatgtccgattggattgccctttttgataacgattgctcaatgctttttgacgtcttgtcaagtttgcgaaggagtgcccataaacca

SEQ ID NO: 15150 - RNA, 134 nt, unidentified
  source 1..134: mol_type = other RNA; note = Related to WMDE01000004.1; note = Photobacterium carnosum
tggtttatgggcagatttggatcgcgcttcgcgatcagtgaaaaaaatgtccgagtggattgcctttaaagtatcatattttctgattctttctgaacttcttgtcaagtttgcgtaggagtgcccataaacct

SEQ ID NO: 15151 - RNA, 135 nt, unidentified
  source 1..135: mol_type = other RNA; note = Related to NZ_SODO01000007.1; note = Oceanimonas baumannii
cggtttatgggcagattttggatcgcgcttcgcgatcagtgaaaaaaatgtccgataggattgcctttaaggtttcatattttctgatgcctttttaacgtaatgtcaagtttgcgtaggagtgcccataaacca

SEQ ID NO: 15152 - RNA, 130 nt, unidentified
  source 1..130: mol_type = other RNA; note = Related to NZ_FNXF01000003.1; note = Rheinheimera pacifica
cggtttatgggcagattttggattgcgtttcgcaatcagtgaaaaaaatgtccgaaaggattgcctctacaatgatatgtacaccatgtctgacaatctcttgtcaacgcgaaggagtgcccataaacca

SEQ ID NO: 15153 - RNA, 131 nt, unidentified
  source 1..131: mol_type = other RNA; note = Related to NZ_JYNJ01000140.1; note = Thalassomonas viridans
cggtttatgggcaggttttggatcgcgcttcgcgatcagtgaaaaaaatgtccgaaaggattgccttttaggagacgatttatacggttcctaatgttccctcaggagtgcataagagtgcccataaaccc

SEQ ID NO: 15154 - RNA, 125 nt, unidentified
  source 1..125: mol_type = other RNA; note = Related to JAHVIP010000004.1; note = Marinobacter daepoensis
aggcttgtgggcagattttgggttgcgattcgcgacttgtgatgacaatgtcctgccgtttgcactcggacgacctttacgtgctctgcagaggacttgaatagcgtaggagtgcccacaagccg

SEQ ID NO: 15155 - RNA, 129 nt, unidentified
  source 1..129: mol_type = other RNA; note = Related to NZ_VMHP01000002.1; note = Marinobacter halotolerans
tggcttatgggcagattttgggtcgcgcttcgcgatctgtgaaaacattgcccgaagggattgcaccttatggacgatctcacgtgtcacattgacgttctgactgagcgaaagagtgcccataagcca

SEQ ID NO: 15156 - RNA, 129 nt, unidentified
  source 1..129: mol_type = other RNA; note = Related to JAHMIN010000032.1; note = Hahella sp.
gggcttatgggcagattttgggtcgcgattcgcgatctgtgaaaacaatgtccgagagaattgctcttgacaggcttttacacgtgactgaatagtacttggtctgtgcgtaagagtgcccataagcct

SEQ ID NO: 15157 - RNA, 128 nt, unidentified
  source 1..128: mol_type = other RNA; note = Related to CP091442.1; note = Pseudoalteromonas sp.
tagcttacgggcagatttttgttcgcgcttcgcgaacagtgaaaaaaatgttcgaacggaccgcctatgaggaaatgtatcatcactttaaggtacttctcgacacgcgtaagagtgcccgtaagcta

SEQ ID NO: 15158 - RNA, 128 nt, unidentified
  source 1..128: mol_type = other RNA; note = Related to BLIJ01000065.1; note = Alteromonas sp.
cggcttatgggcagatattgggtcgcgcttcgcggccagtgataaaattgttagaggggattgccctcaaatttccttgtgacgtctttaagtacctgatgtccgagcgtaggagtgcccataagcca

SEQ ID NO: 15159 - RNA, 125 nt, Vibrio sp.
  source 1..125: mol_type = other RNA; note = Related to NZ_CP016347.1; note = Vibrio natriegens
cagcttatgggcagattttttgttcgcgtttcgcgaacagtgaaaaaatggtccgttcggattgcctgataatcgtattcatgtaggtatttaaatacatagtgcctaggagtgcccataagctc

SEQ ID NO: 15160 - RNA, 127 nt, unidentified
  source 1..127: mol_type = other RNA; note = Related to AAXY01000057.1; note = Marinobacter sp.
tggcttatgggcagatttttagttcgcgtttcgcgatcagtgaaaaaattgtccgtacggattgccttgtatgtatattcatatgtttatatatgattatatggtgcctaggagtgcccataagcca

SEQ ID NO: 15161 - RNA, 126 nt, Vibrio sp.
  source 1..126: mol_type = other RNA; note = Related to JXXT01000002.1; note = Vibrio nigripulchritudo
cggcttatgggcagatttttagctcgagtttcgcgagcagtgaaaaaaacgtccgaacggattgccgagtagaatatttcgtatcaaatgtatgagactatagtgcgtaggagtgcccataagccg

SEQ ID NO: 15162 - RNA, 128 nt, Vibrio sp.
  source 1..128: mol_type = other RNA; note = Related to NZ_CP046804.1; note = Vibrio cidicii
cggcttatgggcagatttttagttcgcgtttcgcgatcagtgaagaaatggtccgttcggattgccttatatagtatatcatataggtatttataggatatatagtgcgtaggagtgcccataagcca

SEQ ID NO: 15163 - RNA, 128 nt, unidentified
  source 1..128: mol_type = other RNA; note = Related to AAVS01000020.1; note = Alteromonadales bacterium TW-7
cggtttatgggcagatttttagttcgcgcttcgcgaacagtgaaaaaattgtccgttcggattgccttataagtgtatctatatgtaaatttatgggatatatagtgcgtaggagtgcccataaacca

SEQ ID NO: 15164 - RNA, 129 nt, unidentified
  source 1..129: mol_type = other RNA; note = Related to PYOV01000005.1; note = Photobacterium angustum
cggcttatgggcagattttttgttcgcgtttcgcgaattgtgaaaaaattgtccgttcggattgcctcgaataaatagttacacaggtattgccagatatacacaatgcctaggagtgcccataagcca

SEQ ID NO: 15165 - RNA, 126 nt, Aeromonas sp.
  source 1..126: mol_type = other RNA; note = Related to NZ_CP024930.1; note = Aeromonas veronii
cggcttatgggcagattattagctcgcgcttcgcgagcagtgaaaaaattgtccacttggattgccctattatagtgtgtcgatgtgcatgctgagcatatagtgcgtaagagtgcccataagcct

SEQ ID NO: 15166 - RNA, 126 nt, Aeromonas sp.
  source 1..126: mol_type = other RNA; note = Related to JAHUWA010000001.1
cggcttatgggcagattcttcgctcgcgcttcgcgagcagtgaaaaaatggtccgttcggattgccctattgtagtgtatcaatgtgctagacgatattatagtgcataggagtgcccataggcca

SEQ ID NO: 15167 - RNA, 127 nt, unidentified
  source 1..127: mol_type = other RNA; note = Related to NZ_MUNJ01000002.1; note = Plesiomonas shigelloides
aggcttatgggcagatttttgctcgcgattcgcgagttgtgaaaccattatccgtctggattgctcataatgtatcatatcgtacgccacgatgaatcttattacgcgtaagagtgcccataagcct

SEQ ID NO: 15168 - RNA, 126 nt, Pseudomonas sp.
  source 1..126: mol_type = other RNA; note = Related to DOLN01000112.1
cggcttatgggcagatttttagctcgcgtttcgcgagtagtgatgatgttgtcggtacggattgcttatgtagtatgtccatagtgttacatgaatggaccagtgcctaggagtgcccataagcca

SEQ ID NO: 15169 - RNA, 127 nt, unidentified
  source 1..127: mol_type = other RNA; note = Related to JABSPA010000005.1; note = Colwellia sp.
tggtttatgggcagatttttcgttcgcgtttcgcgaacagtgaaacaatgatccgtcaggattgcatcatgtagtatttcgaagttgtatcttcagtatgttagtgccaaggagtgcccataagcca

SEQ ID NO: 15170 - RNA, 127 nt, unidentified
  source 1..127: mol_type = other RNA; note = Related to NZ_CP048031.1; note = Shewanella sp.
cggcttatgggcagatttttggttcgcgtttcgcgagcggtgaaacaattgtccgaaaggattgccatattgaagtttgcacgtatcaaatgtcagcataatggtgcataagagtgcccataagcca

SEQ ID NO: 15171 - RNA, 125 nt, unidentified
  source 1..125: mol_type = other RNA; note = Related to JAHKRD010000030.1; note = Shewanella sp.
cggcttatgggcagatttttagttcgcgtttcgcgaacagtgaaaaaatcgtccgttaggattgcataataaatgttatcgctgcttatcgccatgatacagtgcgtaagagtgcccataagcca

SEQ ID NO: 15172 - RNA, 126 nt, unidentified
  source 1..126: mol_type = other RNA; note = Related to NZ_SEUL01000049.1; note = Pseudoalteromonas fuliginea
cggcttatgggcagatttttagttcgcgcttcgcgaacagtgaaacaattatccgtctggattgcatcttatagtttctcatagttgcttccgtatataataatgcctaggagtgcccataagcca

SEQ ID NO: 15173 - RNA, 129 nt, unidentified
  source 1..129: mol_type = other RNA; note = Related to NZ_CP011029.1; note = Pseudoalteromonas espejiana
tggtttatgggcagatttttggtcgcgtttcgcgacctgtgaaaaaattgttcgagagaactgcctattagtagattatcatcattatgaggctacctgagaaaagtgcctaggagtgcccataaacca

SEQ ID NO: 15174 - RNA, 131 nt, unidentified
  source 1..131: mol_type = other RNA; note = Related to NZ_RRZA01000072.1; note = Pseudoalteromonas prydzensis
cggtttatgggcagatttttggtcgcgcttcgcgacttgtgaaacaatcgttcgagagaactgcctactagtagattatcgtacttttcgaagtctatcagattaaagtgcctaggagtgcccataaaccg

SEQ ID NO: 15175 - RNA, 123 nt, unidentified
  source 1..123: mol_type = other RNA; note = Related to JAEMUI010000038.1; note = Marinomonas spartinae
tggcttatggatagatttttgttcgcgcatcgcgaacagtggaacaattgtccgttaggattgccttatagtattatcaatgtccttataatacttatagcgcgtaagagtatccataagcca

SEQ ID NO: 15176 - RNA, 131 nt, unidentified
  source 1..131: mol_type = other RNA; note = Related to NZ_UATK01000001.1; note = Photobacterium damselae
tggtttatgggcagattttggatcgcgtatcgcgatcggtgaaaacaatgtccgaaaggattgccctttgtgaatgatgtttcaaatgtctgaatgtccttactagagtgcgtaagagtgcccataaaccg

SEQ ID NO: 15177 - RNA, 131 nt, unidentified
  source 1..131: mol_type = other RNA; note = Related to NZ_CP012737.1; note = Pseudoalteromonas sp.
tggtttatgggcagattttgggtcgcgtttcgcgatcagtgaaaaaaatgtcgttgacattacctttatgatgattagctgtactttatgatcattactattgttaaatgtgtaggagtgcccataaacca

SEQ ID NO: 15178 - RNA, 128 nt, unidentified
  source 1..128: mol_type = other RNA; note = Related to CP044399.1; note = Moritella marina
cagcttatgggcagatttagatcgcgtttcgcgatccgtgaaaacaatgtcgaaagatattgcctactattgaacggttttgacggttctaataggatctattggtgcataggagtgcccataagcta

SEQ ID NO: 15179 - RNA, 127 nt, unidentified
  source 1..127: mol_type = other RNA; note = Related to JAFWFN010000035.1; note = Halomonas sp.
tggcttatgggcagattttgggtcgcgtatcgcgatcagtgaaaagaatgtccggcaggaatgcatctttagagtgttacacttgacgctaggttgaccttacatgcgtaggggtgcccataagcca

SEQ ID NO: 15180 - RNA, 123 nt, Pseudomonas sp.
  source 1..123: mol_type = other RNA; note = Related to GL385078.1; note = Pseudomonas syringae
cggcttatgggcagatttttggatcgcggatcgcgatcagtgggaaaaatgttcgaaaggctgcctgatgagacctgtcgctacttgacggtccctactgtgcgtaggagtgcccataagcct

SEQ ID NO: 15181 - RNA, 123 nt, Pseudomonas sp.
  source 1..123: mol_type = other RNA; note = Related to CP089282.1; note = Pseudomonas amygdali
cggcttatgggcagatttttggatcgcggatcgcgatcagtgggaaaaatgttcgagatgctgcctgttgagacttgtcgctggttgacggtccctactgtgcgtaggagtgcccataagcct

SEQ ID NO: 15182 - RNA, 125 nt, Pseudomonas sp.
  source 1..125: mol_type = other RNA; note = Related to GL384649.1; note = Pseudomonas amygdali
tggcttatgggcagatttttgggtcgcggatcgcgaccagtggaaacaatgtccgaaagggctgccttatgagacttgtcgatccttgacggtccctccagttgcgtaggagtgcccataagcca

SEQ ID NO: 15183 - RNA, 125 nt, Pseudomonas sp.
  source 1..125: mol_type = other RNA; note = Related to NZ_UTBG01000001.1; note = Pseudomonas viridiflava
tggcttatgggcagattttttgatcgcggatcgcgatctgtggaaacaacgtccgaaagggctgccttatgagacttgtcgcaccttgacggtccttccagtagcgaaggagtgcccataagcca

SEQ ID NO: 15184 - RNA, 125 nt, Pseudomonas sp.
  source 1..125: mol_type = other RNA; note = Related to WIBD01000035.1
tggcttatgggcagatttttggatcgcggatcgcgatcagttaaaacaatgtccgaaagggctgccttatgagacttgtcgacccttgacggtccctccacttgcgtaggagtgcccataagcca

SEQ ID NO: 15185 - RNA, 125 nt, Pseudomonas sp.
  source 1..125: mol_type = other RNA; note = Related to NZ_LHVB01000014.1; note = Pseudomonas chlororaphis
cggcttatgggcagatttatggatcgcggatcgcgatcagtgggaaaaacgtccgaaaggattgccttatgagacttgtcgacacttgacggtccctccgtttgcgtaggagtgcccataagcca

SEQ ID NO: 15186 - RNA, 125 nt, Pseudomonas sp.
  source 1..125: mol_type = other RNA; note = Related to NZ_VJOY01000005.1; note = Pseudomonas mangiferae
tggcttatgggcagattttggatcgcggatcgcgatcagtgaaaacaatgtccgaatggactgccctatgagacttgtcgactctcgacggtccctcaagtttgcgaaggagtgcccataagcca

SEQ ID NO: 15187 - RNA, 125 nt, Pseudomonas sp.
  source 1..125: mol_type = other RNA; note = Related to NZ_JYHV01000007.1; note = Pseudomonas stutzeri
tggcttatgggcagattttggatcgcggatcgcgatcagtgaaaacaatgtccgaaaggactgcccgatgagacttgtcgacttttgacggtccctccagtttgcgtaggagtgcccataagcca

SEQ ID NO: 15188 - RNA, 125 nt, Pseudomonas sp.
  source 1..125: mol_type = other RNA; note = Related to NZ_AVEF02000221.1; note = Pseudomonas syringae
tggcttatgggcagattttggatcgcggatcgcgatcagtgacaacaatgtccgaaaggactgccctatgagacttgtcgactcttgacggtccctccaatttgcgtaggagtgcccataagcca

SEQ ID NO: 15189 - RNA, 124 nt, Pseudomonas sp.
  source 1..124: mol_type = other RNA; note = Related to QLTL01000007.1
aggcttatgggcagattttggatcgcggatcgcgatcagtgaaaacaatgtccgaaaggactgccctatgagacttgtcgacgtttgacggtccctccagttgcgtaggagtgcccataagccg

SEQ ID NO: 15190 - RNA, 125 nt, Pseudomonas sp.
  source 1..125: mol_type = other RNA; note = Related to NZ_CP018743.1; note = Pseudomonas putida
aggcttatgggcagattttggatcgcggatcgcgatcagtggaaaaaacgtccgaaaggactgccttatgagacttgtcgacttttgacggtccctccagtttgcgtaggagtgcccataagcca

SEQ ID NO: 15191 - RNA, 126 nt, Pseudomonas sp.
  source 1..126: mol_type = other RNA; note = Related to NZ_JZRI01000162.1
tggcttatgggcagattttggatcgcggatcgcgatcagtggtaacaatgtccgaaagactgctcctatgaggctcctctctgcttaagagtccctccaagtttgcgaaggagtgcccataagcca

SEQ ID NO: 15192 - RNA, 124 nt, Aeromonas sp.
  source 1..124: mol_type = other RNA; note = Related to JAGDEY010000009.1; note = Aeromonas veronii
cggcttatgggcagattttggatcgcggatcgcgatcagtgaaaataatgtccggaaggacttgcctttgcgacttggcgagtcgcgctacacgagatgagtgcgtaggagtgcccataagcca

SEQ ID NO: 15193 - RNA, 125 nt, Aeromonas sp.
  source 1..125: mol_type = other RNA; note = Related to NZ_UETN01000024.1; note = Aeromonas allosaccharophila
cggcttatgggcagattttgggtcgcggatcgcgatcagtgaaaacaatgtccgaaaggacttgccttgtgcgacttggcgagtcgctatgctcgaaatgagtgcgaaggagtgcccataagcca

SEQ ID NO: 15194 - RNA, 126 nt, Pseudomonas sp.
  source 1..126: mol_type = other RNA; note = Related to JACAQA010000043.1
tggcttatgggcagattttggatcgcgtatcgcgatcagtggaaaaattgtccgaaaggattgccccctatgagacttgtcgcttcttgacagtccctacagtagcgtaagagtgcccataagcca

SEQ ID NO: 15195 - RNA, 124 nt, Pseudomonas sp.
  source 1..124: mol_type = other RNA; note = Related to POEK01000001.1
tggcttatgggcagattttggatcgcgaatcgcgatcagtgggaaaaatgttggaatgctttgcccggtgagaattgtcatgtcttgaggttctctacgtttgcgaaagagtgcccataagcct

SEQ ID NO: 15196 - RNA, 127 nt, Pseudomonas sp.
  source 1..127: mol_type = other RNA; note = Related to NZ_LT629790.1; note = Pseudomonas mediterranea
cggcttacgggcagattttggatcgcgcatcgcgatcagtgaaaaaattgtccgaaaggattgcccttgtagtgacttgtcgattcttgacggtcctggcacagtgcgtaggagtgcccgtaagccc

SEQ ID NO: 15197 - RNA, 127 nt, Pseudomonas sp.
  source 1..127: mol_type = other RNA; note = Related to JAJSQA010000022.1; note = Pseudomonas monteilii
cggcttacgggcagattttggatcgcgcatcgcgatcagtgaaaaaattgtccgaaaggattgcccttgtggtgacttgtcgcttcttgacggtcctggcagagtgcgtaggagtgcccgtaagccc

SEQ ID NO: 15198 - RNA, 127 nt, Pseudomonas sp.
  source 1..127: mol_type = other RNA; note = Related to NZ_CP076652.1; note = Pseudomonas savastanoi
cggcttacgggcagattttggatcgcgcatcgcgatcagtgaaaaaattgtccgaaaggattgcccttgtggtgacttgtcgcttcttgacggtcctggcacagtgcgtaggagtgcccgtaagcca

SEQ ID NO: 15199 - RNA, 125 nt, Pseudomonas sp.
  source 1..125: mol_type = other RNA; note = Related to NZ_JAHTKI010000003.1; note = Pseudomonas botevensis
cggtttacgggcagattttgggtcgcgcatcgcgatcagtgaaaaaattatccgaaaggattgcccttgagatgacttagcgattcttcgcggtcctggtaatgcgtaagagtgcccgtaagcca

SEQ ID NO: 15200 - RNA, 125 nt, Pseudomonas sp.
  source 1..125: mol_type = other RNA; note = Related to NZ_LN854573.1
cggcttacgggcagattttgggtcgcgtatcgcgaccagtgaaaccattgtccgaaaggattgcccttgtggagacttgtcgattcttgacggtcctggcggtgcgtaggagtgcccgtaagcca

SEQ ID NO: 15201 - RNA, 126 nt, Pseudomonas sp.
  source 1..126: mol_type = other RNA; note = Related to NZ_VLKY01000029.1; note = Pseudomonas duriflava
cggcttacgggcagattttgggtcgcgcatcgcgatcagtgaaaaaatggtccgaaaggattgcccttggtggagactcatcgattctctacggtcctggcagtgcctaggagtgcccgtaagccg

SEQ ID NO: 15202 - RNA, 126 nt, Pseudomonas sp.
  source 1..126: mol_type = other RNA; note = Related to NZ_CP044074.1; note = Pseudomonas oryzihabitans
tggcttacgggcagattttgggtcgcgtatcgcgatcagtgaaaaaatggtccgaaaggattgccctttgtggagacttgtcgattctctacggtcctggctgtgcctaggagtgcccgtaagcca

SEQ ID NO: 15203 - RNA, 128 nt, unidentified
  source 1..128: mol_type = other RNA; note = Related to NZ_PNRF01000034.1; note = Halomonas endophytica
tggcttatgggtagattttggatcgcgtatcgcgatcagtgaaaaaattgtccgaatggattgccctttgaacaatatgtcatatcttaaatgttccttgacgtttgcaaaagagtacccataagcca

SEQ ID NO: 15204 - RNA, 128 nt, unidentified
  source 1..128: mol_type = other RNA; note = Related to QOAT01000087.1; note = Thiothrix sp.
cggcttatgggcagattttgggtcgcgaatcgcgatcagtgaaaataatgtccatttggattgcctttaatggtgactatgcgtatcaagtatgatccattgcagtgcgaaagagtgcccataagcca

SEQ ID NO: 15205 - RNA, 128 nt, unidentified
  source 1..128: mol_type = other RNA; note = Related to JAHJJI010000033.1; note = Gammaproteobacteria bacterium
tggcttatgggcagattttgggtcgcgcatcgcgatcagtgaaaaaaatgtccgtctggattgcccttaacagtgattatgcttactcgataatctcattgacagtgcaaaagagtgcccataagcct

SEQ ID NO: 15206 - RNA, 128 nt, unidentified
  source 1..128: mol_type = other RNA; note = Zetaproteobacteria bacterium; note = Related to NVWS02000073.1
cggcttatgggcagattttgggtcgcggatcgcgatcagtgaaaacaatgtccgaaaggattgcctacggaagtgatatacgcaacttaatatcctccatgctggtgcgtaagagtgcccataagcca

SEQ ID NO: 15207 - RNA, 129 nt, unidentified
  source 1..129: mol_type = other RNA; note = Related to NZ_BDMN01000304.1
cggcttataggcagattttgggtcgtgtatcgcgaccagtgaaaaaaatatccggacggattgccccttaaaagttctctacagattaactagagaatacgtattacgcataagagtgcctataagcca

SEQ ID NO: 15208 - RNA, 128 nt, unidentified
  source 1..128: mol_type = other RNA; note = Related to NZ_VTUU01000001.1; note = Marinobacter salinexigens
tggcttatgggcagattttggatcgcggatcgcgatcagtggaaaaaatgtcccagtacattgcccttaagattgcgtctcgtaatgctgcagtctcccccagggtgcgtaggagtgcccataagcca

SEQ ID NO: 15209 - RNA, 127 nt, Aeromonas sp.
  source 1..127: mol_type = other RNA; note = Related to NZ_CP045311.1; note = Aeromonas dhakensis
tggcttatgggcagatttttgactttgtttcggagtctgtgaaaaaaatgtccgctggactgccccctaagcgatatcaccgccacgccgagatgtcgcgcgcttgcgtaggagtgcccataagcca

SEQ ID NO: 15210 - RNA, 127 nt, Aeromonas sp.
  source 1..127: mol_type = other RNA; note = Related to NZ_CP012504.1; note = Aeromonas veronii
tggcttatgggcagatttttgactttgtttcggagtctgtgaaaataatgtccgctggactgccccctaagcgatatcagcaccacgctgagatgtcgcgcgcttgcgtaggagtgcccataagcca

SEQ ID NO: 15211 - RNA, 131 nt, unidentified
  source 1..131: mol_type = other RNA; note = Gammaproteobacteria bacterium; note = Related to JABXIW010000056.1
aggtttatgggcagattttgggtcgcgtatcgcgatcagtgaaaagaatgtccgataggattgcctatagtaacgatatgactaatcatttatagtcatttgcataacagcgtaagagtgcccataaatct

SEQ ID NO: 15212 - RNA, 129 nt, unidentified
  source 1..129: mol_type = other RNA; note = Related to WOBJ01000032.1; note = Aliivibrio fischeri
cagcttacgggcagattttgggttgcgcatcgcaatcagtgaaaaaaatgtctgagagactcgcctttaatgtgatattacgtttcttcttaatatccctgactagtgcataggagtgcccgtaagcta

SEQ ID NO: 15213 - RNA, 128 nt, Vibrio sp.
  source 1..128: mol_type = other RNA; note = Related to NZ_JABEQC010000006.1; note = Vibrio plantisponsor
tagcttacgggcagattttgggttgcgtatctgcaatcagtgaaaaaaatgtcctagagacttgctttttggcgattatgctaatttttgataatccctgactagtgcgtaagagtgcccgtaagcta

SEQ ID NO: 15214 - RNA, 128 nt, Vibrio sp.
  source 1..128: mol_type = other RNA; note = Related to NZ_SMJS01000006.1; note = Vibrio echinoideorum
tagcttacgggcagattttgggtggcgtatcgccatcagtgaaaacaacgtctgatagacttgcctttataatgtaatgttcagtttctctatgatcctcgacatggcataggagtgcccgtaagcga

SEQ ID NO: 15215 - RNA, 125 nt, unidentified
  source 1..125: mol_type = other RNA; note = Related to NZ_CP028355.1; note = Shewanella baltica
tagcttacgggcagattttgggttgcgtatcgcaatcagtgaaaaaaatgtctgatagactcgccttatgaatagttacattacttctaatgtctctgactatgcgaaggagtgcccgtaagcta

SEQ ID NO: 15216 - RNA, 129 nt, Vibrio sp.
  source 1..129: mol_type = other RNA; note = Related to NZ_CAJFAE010000018.1; note = Vibrio jasicida
aagcttacgggcagattatgggttgcgaatcgcaatcagtgaaaaaaatgtccgagagactagcctttatcagggatgttacgtttcttgttctatccttgaccagtgcataagagtgcccgtaagcta

SEQ ID NO: 15217 - RNA, 128 nt, unidentified
  source 1..128: mol_type = other RNA; note = Related to WMDE01000033.1; note = Photobacterium carnosum
ttgcttacgggcagattttgggttgcgtatcgcaatcagtggaaaaaatgtcctagagactagcccttaactggaatttacgattcttctcgtatccttgtccagcgcataagagtgcccgtaagctc

SEQ ID NO: 15218 - RNA, 126 nt, Vibrio parahaemolyticus
  source 1..126: mol_type = other RNA; note = Related to CP040103.1
tggtttgcgggtagatcttgggttgcgtatcgcaatcagtgaaaacaatgtcgccaagactagccctttaacgatttgacggattctttccgattcacctcggtgcgaaagagtacccgcaaacca

SEQ ID NO: 15219 - RNA, 127 nt, unidentified
  source 1..127: mol_type = other RNA; note = Related to NZ_JAFFZP010000001.1; note = Amphritea pacifica
gggcctattggcagattttttggctgcgattcgcagtctgtgacaacaatgtctgaatctctcgccttcgcagttgaatggatcactatgtgactgcagcaatgagcgtaagagtgccaataggctc

SEQ ID NO: 15220 - RNA, 128 nt, unidentified
  source 1..128: mol_type = other RNA; note = Related to NZ_PYGI01000034.1; note = Marinobacterium halophilum
cagcctattggtagattttgggctgcgattcgcagtctttgacaaaaacgtccgaaacactcgccttcgcagttagatgcttacactatgtgaatgcatgcaatacgcgtaagagtaccaataggctc

SEQ ID NO: 15221 - RNA, 127 nt, Aeromonas sp.
  source 1..127: mol_type = other RNA; note = Related to NZ_CP077301.1
cggcttatgggcagattttggattgtgtttcgcaatcagtgaaaaaaatgtcccacaggactcgccatatggcggattgacgcagtgtcgattccgaatataagtgcataagagtgcccataagcct

SEQ ID NO: 15222 - RNA, 130 nt, unidentified
  source 1..130: mol_type = other RNA; note = Related to NZ_KB902175.1; note = Mariprofundus ferrooxydans
tggcttatgggcagattttggattgtgatatcgcaatcagtgaaaaaattgtccaatggactcgccccacgggtacgttaatttagcggatctgtgtaacttaagaatgcgtaagagtgcccataagcca

SEQ ID NO: 15223 - RNA, 134 nt, unidentified
  source 1..134: mol_type = other RNA; note = Related to JABWTG010000018.1; note = Desulfuromonas acetoxidans
acgcttatgggcagattttggattgcgtttctgcaatcagtgaaaaaatggtgtcgcatcattcgcccgatagcggcccttcaatgttactggtcacatgactaaaatagatgcgtaggagtgcccataagcac

SEQ ID NO: 15224 - RNA, 135 nt, unidentified
  source 1..135: mol_type = other RNA; note = Related to WJFN01000003.1; note = Morganella morganii
cagctcacatgcagatttgttggttgcgtttcgcaacctgtgacgacattgtctaagtgattcgccttctcggattgcgccattatagcgtatctgaattacctgctagccgcgcgtaagagtgcatgtgggcta

SEQ ID NO: 15225 - RNA, 131 nt, unidentified
  source 1..131: mol_type = other RNA; note = Related to NZ_QKLW01000003.1; note = Marinomonas alcarazii
cggctcacatgcagatttgctggttgcgtttcgcaacctgtgacaacatggtccaagtgactcgccttctaggatgctacattgcgttcttgaattactcgctagcggcgcgtaagagtgcatgtgagcta

SEQ ID NO: 15226 - RNA, 134 nt, unidentified
  source 1..134: mol_type = other RNA; note = Related to NZ_FOGS01000013.1; note = Halomonas subterranea
acgctcacatgcagatttgttgattgcgtttcgcaatctgtgacaacatcgtctaagtgactcgccttctcggattgctccatattgctttcctgaattactcgctagcggcgcgtaagagtgcatgtgagcta

SEQ ID NO: 15227 - RNA, 134 nt, unidentified
  source 1..134: mol_type = other RNA; note = Related to BMQV01000045.1; note = Shewanella saliphila
tggctcacatgcagatttgttggttgcgtttcgcaacctgtgacaacattgtccaagtgactcgccttctcggattgctccatattgctttcctgaattactcgctagcggcgcgtaagagtgcatgtgagcta

SEQ ID NO: 15228 - RNA, 133 nt, unidentified
  source 1..133: mol_type = other RNA; note = Related to NC_008750.1; note = Shewanella sp.
tagctcacatgcagatttgttggttgcgtttcgcaacctgtgacaacatggtccaagtgactcgccttctcggatcgcttcatatgctttcctgaatgactcgcccgcggcgcgtaagagtgcatgtgagcta

SEQ ID NO: 15229 - RNA, 133 nt, unidentified
  source 1..133: mol_type = other RNA; note = Related to BAEQ01000054.1; note = Glaciecola pallidula
atgctcacatgcagatttgttggttgcgtttcgcaatctgtgatgacattgtcaatttgactcgccttctcggaatagtctttgagctatcctgaagtacttgccagccgcgcgtaagagtgcatgtgagcac

SEQ ID NO: 15230 - RNA, 131 nt, unidentified
  source 1..131: mol_type = other RNA; note = Related to NZ_RXNU01000007.1; note = Shewanella canadensis
aggctcacatgcagatttgttggttgcgcttcgcaaccagtgaccacattgtctaagagactcgcctttcggattgctaatatgccttccggaactactcgccagctgcgcgaaagagtgcatgtgagccg

SEQ ID NO: 15231 - RNA, 133 nt, unidentified
  source 1..133: mol_type = other RNA; note = Related to NZ_RSFE01000007.1; note = Pseudidiomarina gelatinasegens
cggctcacatgcagatttgttggttgcgcttcgcaacctgtgacaacattgctagatagactcgcctttcggactactcgtttgagcgtcctggaactactcgccagccgcgcgtaggagtgcatgtgagcca

SEQ ID NO: 15232 - RNA, 131 nt, unidentified
  source 1..131: mol_type = other RNA; note = Related to NZ_JAGPNM010000010.1; note = Rheinheimera sp.
tggctcacatgcagatttgttggctgcgcttcgcagcctgtggcaaaattgtcagatagactcgcctttcggacaccatcaacacgtcctggaactactcgccagccgcgcgtaggagtgcatgtgggcca

SEQ ID NO: 15233 - RNA, 130 nt, unidentified
  source 1..130: mol_type = other RNA; note = Related to NZ_JADZGP010000013.1; note = Shewanella algae
cggctcacatgcagatttgtgggttgcgcttcgcaacctgtgacaacatggtctgatagactcgcctattcggattgcttatggctttctggaaatactcgctgcggcgcgtaggagtgcatgtgagcca

SEQ ID NO: 15234 - RNA, 131 nt, unidentified
  source 1..131: mol_type = other RNA; note = Related to NC_016745.1; note = Oceanimonas sp.
cggctcacatgcagatttgttggttgcgcttcgcaacctgtgacaacatggtccgatggactcgccttcttggatatcgcctagtcttgctggaaatactgctagcggcgcgtaggagtgcatgtgggcca

SEQ ID NO: 15235 - RNA, 133 nt, Aeromonas sp.
  source 1..133: mol_type = other RNA; note = Related to NZ_JRBE01000001.1; note = Aeromonas veronii
aggctcacatgcagatttgttgattgcgaagcgcaatctgtgttaacaatgtccgagtgactcgccttatcggattgcatattattcgatgtcgaatatattgctagccgcgccaaggagtgcatgtgggcct

SEQ ID NO: 15236 - RNA, 136 nt, Vibrio sp.
  source 1..136: mol_type = other RNA; note = Related to ABBKEB010000006.1; note = Vibrio vulnificus
cggctcacacacagatttgttggttgcgtttcgcaacctgtgaaaaaaacgtccgagtgactcgctatgtaatgattatcgttacgtatcattctgacagtacctgctggcagcgccaaagagtgtgtgtgagcca

SEQ ID NO: 15237 - RNA, 130 nt, Vibrio sp.
  source 1..130: mol_type = other RNA; note = Related to MAKF01000119.1; note = Vibrio splendidus
gggctcacatccagatttgttggttgcgtttcgcaacctgtgaaaaaaatgtccgagtgactcgccttttgattacaaattgtgcaggtagcaatatatcgcttatgcgcgtaagagtgaatgtgagccc

SEQ ID NO: 15238 - RNA, 132 nt, Vibrio sp.
  source 1..132: mol_type = other RNA; note = Related to CP016228.1; note = Vibrio crassostreae
tggcttatagacagacttttggttgtgtttcgcaacctgtgaaaaaaatgtccgtaggactcgctaatattactgtgctactagtgtaattgtaaacttatgccggcggcgcaagggagtgtctataagcct

SEQ ID NO: 15239 - RNA, 128 nt, unidentified
  source 1..128: mol_type = other RNA; note = Related to NZ_LR134189.1; note = Providencia rustigianii
gagtatgcaggcagattttttagttgtgtttcgcaactagtgaaaacaagggcagaatcgctcgctaatatgattaaagttgtaacgctatgatgagatttgatgcgcaaaggagtgcctgcatactc

SEQ ID NO: 15240 - RNA, 127 nt, unidentified
  source 1..127: mol_type = other RNA; note = Related to WLUH01000023.1; note = Providencia sp.
gagcatgcaggcagattttttagttgtgtttcgcaactactaaaaacaagggcaggatcgctcgccaatataatcataattgtaacgctatgataggtttgtaatgcaaaagagtgcctgcatgctc

SEQ ID NO: 15241 - RNA, 131 nt, Proteus sp.
  source 1..131: mol_type = other RNA; note = Related to JAGKMM010000039.1; note = Proteus mirabilis
gagcatgtaggcagattttgggattgtgtatcacaatcattgaaaacaacgggtggatatctcgcccactatgattctcatagtattcctagcgattaatcgtagctttgcataagagtgcttacatgctc

SEQ ID NO: 15242 - RNA, 133 nt, Proteus sp.
  source 1..133: mol_type = other RNA; note = Related to JH815505.1; note = Proteus mirabilis
tggtatgcaggcagatttttgaattgtgtttcgcaattcttgatttcaagggtagaagttctcgcctgctatgatgaatcatagcgtaatctgcttacaatatgtaaaagtgcgtaagagtgcctgcatacct

SEQ ID NO: 15243 - RNA, 131 nt, unidentified
  source 1..131: mol_type = other RNA; note = Related to NZ_CP086257.1; note = Providencia rettgeri
cggtatgcaggcagatttttgaattgtgcatcgcaattcttgattttaatggcgggatttctcgctgctatgatgaatcatagcataatatgctaagtatatgaaaagtgcgtaagagtgcctgcatacct

SEQ ID NO: 15244 - RNA, 133 nt, unidentified
  source 1..133: mol_type = other RNA; note = Related to NZ_JAJAVX010000005.1; note = Yersinia bercovieri
tggtgtgcaggcagatttttgaattgtgtttcgcaattcttgatttaaagggcagaaactctcgcctgctatgattctcatagcataatctgcttagaatattataaaagtgcataagagtgcctgcacaccg

SEQ ID NO: 15245 - RNA, 132 nt, unidentified
  source 1..132: mol_type = other RNA; note = Related to NZ_VOUX01000033.1; note = Serratia bockelmannii
cggtgtgcaggcagaattttgaattgtgtttcgcaattcttgatttcaagggctcaagctctcgctgctatgattctcatagcaggatttgctgggaatactgtaaaagtgcgtaagagtgcctgcacaccg

SEQ ID NO: 15246 - RNA, 132 nt, unidentified
  source 1..132: mol_type = other RNA; note = Related to NZ_CP067391.1; note = Klebsiella grimontii
tggtgtgcaggcagaattttgaattgtgtttcgcaattcttgatttcaagggctcaagctctcgctgctatgattctcatagcagtatttgctgataatattgtaaaagtgcgtaagagtgcctgcacactg

SEQ ID NO: 15247 - RNA, 133 nt, unidentified
  source 1..133: mol_type = other RNA; note = Related to UKYY01000005.1; note = Klebsiella pneumoniae
tggtgtgtgggcagaattttgaattgtgtttcgcaattcttgatttcaagggcagaacttctcgcctgctatgatcctcatagcttaatctgcttataatgctgtataagtgcgtaagagtgcctgcacaccg

SEQ ID NO: 15248 - RNA, 132 nt, unidentified
  source 1..132: mol_type = other RNA; note = Related to JAHVXV010000003.1; note = Pantoea allii
aggtgtgcaggcagatttttgaattgtgtttcgcaattcttgatttaaagggcagaaagtctcgcccgctatgattctcatagctatatctgcttagtatttttcaaagtgcataggagtgcctgcacacct

SEQ ID NO: 15249 - RNA, 131 nt, unidentified
  source 1..131: mol_type = other RNA; note = Related to CP003085.1; note = Pantoea ananatis
aggtgcgcaggcagatttttaggttgtgtttcgcaatcttttattttcaatgttacaagttctcgcctgctatgattctcatagcgtatcttgcggtcaacggttaaatgcataggagtgcccgcgcaccg

SEQ ID NO: 15250 - RNA, 131 nt, Citrobacter sp.
  source 1..131: mol_type = other RNA; note = Related to CP056336.1; note = Citrobacter freundii
aggcatgcaggtagatttttgggttgtggttcgcaatccttgatttcaacggcagaagttctcgccgctatgattctcatagctaatcagcttagaatggatcaaatacgcataggagtgcctgcatgccg

SEQ ID NO: 15251 - RNA, 131 nt, Escherichia coli
  source 1..131: mol_type = other RNA; note = Related to CP061264.1
acgcatgtaggcagatttgttggttgtgaatcgcaaccagtggccttaatggcaggaggaatcgcctccctaaaatccttgattcagagctatacggcaggtgtgctgtgcgaaggagtgcctgcatgcgt

SEQ ID NO: 15252 - RNA, 131 nt, Enterobacter sp.
  source 1..131: mol_type = other RNA; note = Related to NZ_QZCS01000001.1; note = Enterobacter chuandaensis
gcgcatgtaggcagatttgttggttgtgaatcacaaccagtgatctaaatggcaggaggtatcgcctccctgaaatccttgtttcgacgccataaggccacgatgctgtgcgaaggagtgcctacatgcgc

SEQ ID NO: 15253 - RNA, 131 nt, unidentified
  source 1..131: mol_type = other RNA; note = Related to NZ_JAJNQS010000015.1; note = Lelliottia nimipressuralis
gcgcatgtaggcagatttgttggttgtgtatcacaaccagtgattttaatggcaggtggaatcgcatccctgacatccttgtttcgtcgctataaggccattgtgctgtgcgaaggagtgcctacatgcgt

SEQ ID NO: 15254 - RNA, 129 nt, unidentified
  source 1..129: mol_type = other RNA; note = Related to NZ_CP084222.1; note = Arsenophonus sp.
gcgtatgtaggtagatttgttggttgtgtatcgcaaccggtcattttaatggcgggaactctcgctttccttgaattgttctaatggcaatgcggtaattaagctgcgcgaaagagtacctacatacgt

SEQ ID NO: 15255 - RNA, 128 nt, unidentified
  source 1..128: mol_type = other RNA; note = Related to QKNL01000001.1; note = Klebsiella pneumoniae
gcgcgtgtaggcagatttgttgattgtgaatcgcaatcagtgaccgcaatgttagggggtttcgcccgataacagctttgagtcgccgccagatggattatgcggtgcgaaggagtgcctgcatgcgc

SEQ ID NO: 15256 - RNA, 129 nt, Escherichia coli
  source 1..129: mol_type = other RNA; note = Related to AP022044.1
gcacatgcaggtagatttgttggttgtggtatcgcaatcagtgttaacaaggtcgggagtattcgccctctgactgccgtcaagtcatcttggcgtcaccgttaaatgcgtaagagtacctgcatgtgc

SEQ ID NO: 15257 - RNA, 132 nt, unidentified
  source 1..132: mol_type = other RNA; note = Related to CP047281.1; note = Klebsiella quasipneumoniae
gcacataggggcagatttgtaggttgtggtatcgcagcctgtgatctaaatgtgagagggactcgccttctgacatccttgtttcatcgtttcgtataactctatgctttgcgtaagagtgcccctatgtgt

SEQ ID NO: 15258 - RNA, 131 nt, unidentified
  source 1..131: mol_type = other RNA; note = Related to WBVV01000002.1; note = Klebsiella pneumoniae
gcacatgtaggcagatttgttggttgtggtatcgcaatcagtgatctaaatgttagatggattcgccttctgacatccttgtagccattcttgggctgtcctatgctttgcgtaagagtgcctacatgtgc

SEQ ID NO: 15259 - RNA, 129 nt, unidentified
  source 1..129: mol_type = other RNA; note = Related to JAGOYO010000023.1; note = Vitreoscilla sp.
gggtatgcagatagattattaggttgtgcttcacaaccttttttaaaatattaggccaagttggtactaggcttcatttacacctacgtcaaattacttgacgctacgcaaaagagtgtctgcataccc

SEQ ID NO: 15260 - RNA, 146 nt, Bacillus sp.
  source 1..146: mol_type = other RNA; note = Related to CP024204.1; note = Bacillus altitudinis
aaacgtgtggctagattattcgcttgtgtttcgcaagtgttgaccaaaatggtaggagcattagcttctgctattcgtattactattggtgtatttacgttaaattttcaatgtttctgcatcgcataatgagtagccacacgttc

SEQ ID NO: 15261 - RNA, 144 nt, Bacillus sp.
  source 1..144: mol_type = other RNA; note = Related to JH791914.1; note = Bacillus cereus
aaacgtgtggctagattttttcgcttgtgtttcgcaagtgttgacaaaaatggtgggagcattagcttttctcatccgcatgatcacgttggtatatttttcgatgtacccggcctgcatcgcctaatgagtagccacacgttt

SEQ ID NO: 15262 - RNA, 145 nt, unidentified
  source 1..145: mol_type = other RNA; note = Related to JACWFJ010000008.1; note = Cytobacillus firmus
ttacgtgtggctagattttttcgcttgtgtttcgcaagtgttgacaaaaatggtgggaacattagcttctcctatcctaacttagcatgatcgtatatttatcgatttggtcgattttgtccgcataatgagtagccacacgttt

SEQ ID NO: 15263 - RNA, 143 nt, unidentified
  source 1..143: mol_type = other RNA; note = Related to NZ_ML122604.1; note = Rummeliibacillus sp.
agtcgtgtggctagactttttcgcttgtgtttcgcaagtgttgacaaaaatggtaggaggattagcttctattattcttaatatttaccggattttatataaatctattagtttttcactgcataatgagtagccacacgctt

SEQ ID NO: 15264 - RNA, 146 nt, Bacillus sp.
  source 1..146: mol_type = other RNA; note = Related to NFCM01000080.1; note = Bacillus thuringiensis
taacgtgtggctagattttttcgcttgtgcttcgcaagtgttgacaataatggtgggagcattcgcttctccgattctaattatccgcatggaggtatcttctaaggtaaactcgccgcctctgcctaatgagtagccacacgttt

SEQ ID NO: 15265 - RNA, 146 nt, Bacillus sp.
  source 1..146: mol_type = other RNA; note = Related to NZ_CP015611.1; note = Bacillus safensis
taacgtgtggctagattttttcgcttgtgtttcgcaagtgttgacaataaaggtgggagcattcgcttctccgattctaactatctacttggaggtaacttttacggtaaactcgacgcctctgcataatgagtagccacacgttt

SEQ ID NO: 15266 - RNA, 140 nt, Bacillus sp.
  source 1..140: mol_type = other RNA; note = Related to CP048002.1; note = Bacillus velezensis
tagcgtgtggctagatctttttgcttgtgtttcgcaagtgttgactaaaatggtgagaacatttgcttctcctattatcatattggtgtattattcgccgatgtatccgatattaccgcataatgagtagccacacgttt

SEQ ID NO: 15267 - RNA, 147 nt, Bacillus sp.
  source 1..147: mol_type = other RNA; note = Related to CP048852.1; note = Bacillus tequilensis
atgcgtgtggctagattttttcgcttgtgtttcgcaagtgttgacaaaaatggtagaggcatttgcttctccgactctccgtattaccatgtcggtaaatttgctgatgtgtacagttttcaacgcctaatgagtagccacacgtta

SEQ ID NO: 15268 - RNA, 149 nt, unidentified
  source 1..149: mol_type = other RNA; note = Related to JADPRZ010000022.1; note = Sporosarcina sp.
atgcgtgtggctagatttttttcgcttgtgtttcgcaagtgttgacaaaaatggtgggaacattagcttctcctattcctaatacttatcatgtcggtatatttaccgatttatccgattagcttcgcataatgagtagccacacgttt

SEQ ID NO: 15269 - RNA, 147 nt, unidentified
  source 1..147: mol_type = other RNA; note = Related to NZ_LQYA01000064.1; note = Sporosarcina koreensis
aaacgtgtggctagattttttcgcttgtgtttcgcaagtgttgacaaaaatggtgggagcattagcttctactattccaatatttatcatgtcggtatggttgccgatatgtcctattagcttcgcataatgagtagccacacgttt

SEQ ID NO: 15270 - RNA, 147 nt, unidentified
  source 1..147: mol_type = other RNA; note = Related to NZ_QRDZ01000063.1; note = Cohnella phaseoli
aaacgtgcggctagatttttcacttgtgcttcgcaagtgttgtcaaaaatggtggggatatttgctctctctcatataagcggtgtttgccgaagtagttgtctcttatcatcgcgttttcatcgcataatgagtagccgcacgtac

SEQ ID NO: 15271 - RNA, 144 nt, unidentified
  source 1..144: mol_type = other RNA; note = Related to NZ_CP073365.1; note = Paenibacillus tritici
aaacgtgcggctagatttttcacttgtgcttcgcaagtgttggcataaatggtgggattgtttgcttcctctcatattagtattagccgtaatagtcatctcttatcatcgcgttttcatcgcataaggagtagccgcacgtac

SEQ ID NO: 15272 - RNA, 146 nt, unidentified
  source 1..146: mol_type = other RNA; note = Related to NZ_BMEY01000002.1; note = Ornithinibacillus halotolerans
aagcgtgtggctagatttttcgcttgtgtttcgcgagtgttggcaataatggttgggagattagcttctccgtactatcatgtattatcatgtatgagcaatgttgatatattgatcatgttcgcctaatgagtagccacacgtat

SEQ ID NO: 15273 - RNA, 145 nt, unidentified
  source 1..145: mol_type = other RNA; note = Related to FNNT01000003.1; note = Paenibacillus sp.
atgcgtgtggctagatctttcgcttgtgtttcgcaggcgttaacaaaaatgtcgggaggatttgcttctctctattctatttttatcgttttatgatattcgctaatttgatcggattaatcgcataatgagtagccacacgtgt

SEQ ID NO: 15274 - RNA, 138 nt, unidentified
  source 1..138: mol_type = other RNA; note = Related to JAIEZV010000001.1; note = Halobacillus sp.
tagcgtgtggctagatttttcgcttgtgcttcgcaagcgttgacaataatggtgggaacattagcttctcgtattctattaaatttgactatttggtcgttttattagcatgatcgcataatgagtagccacacgtta

SEQ ID NO: 15275 - RNA, 136 nt, unidentified
  source 1..136: mol_type = other RNA; note = Related to NZ_RBVX01000055.1; note = Salibacterium salarium
aaacgtgtggctagattttattacttgtgtttcgcaagtagtgacaaaaatggtgggcacattcgctgtcgtcattctatcgatcatctatcgctttatgatcgctttgcttcgcttaaggagtagccacacgttt

SEQ ID NO: 15276 - RNA, 124 nt, unidentified
  source 1..124: mol_type = other RNA; note = Related to LFJO01000006.1; note = Alkalihalobacillus pseudalcaliphilus
ttgcgtgtggctagatttttttggcttgtgtatcgcaagcgtttacaacaatggtggggacatttgctttcctattattctattattatccgctattaattgcttaatgagtagccacacgtac

SEQ ID NO: 15277 - RNA, 148 nt, Bacillus sp.
  source 1..148: mol_type = other RNA; note = Related to NVIC01000027.1; note = Bacillus toyonensis
aatcgtgtggctagattattcgacttgtgtttcgcaagtcttatcaggaagggggggagcttttgcttctcttccacatttacttagtagtctttgcttactatgctattttgctattttgcttcgcgtaaggagtagccacacgttt

SEQ ID NO: 15278 - RNA, 141 nt, Bacillus sp.
  source 1..141: mol_type = other RNA; note = Related to NVFR01000056.1; note = Bacillus toyonensis
aatcgtgtggctagagtatttgacttgtgtttcgcaagttttgtcaagaaagtggggggcgtttgccctctctattaagtttacttagtagtctttatttactaaactatttagcttcgcctaaggagtagccacacgttt

SEQ ID NO: 15279 - RNA, 126 nt, unidentified
  source 1..126: mol_type = other RNA; note = Related to NC_016894.1; note = Acetobacterium woodii
atgcacgcggctagattttgtgtctgtggttcgcagacgttgaaaaaaatgtgggggacttttgcttactacatcaatttaaattatttgccataataatttgtcataatgagtagccgcgtgcac

SEQ ID NO: 15280 - RNA, 140 nt, unidentified
  source 1..140: mol_type = other RNA; note = Related to NZ_AP024845.1; note = Eubacterium sp.
aaacgtgtggttagattatggacttgtgtttcgcaagtattggtgaaaatggtaggaagatatgctctctatcaatctgtattatgcttatgtatattttattatatattacgcatcgcataatgagtaaccacacgttt

SEQ ID NO: 15281 - RNA, 129 nt, unidentified
  source 1..129: mol_type = other RNA; note = Clostridiales bacterium; note = Related to JAAYPT010000052.1
aagcgtgtggttagattgtggacttgtgtttcgcaagtgttgactaaaatggtaggaagatatgctctcttatcaatccattctatgtgtatgtatattacgcattgcataatgagtaaccacacgttt

SEQ ID NO: 15282 - RNA, 142 nt, unidentified
  source 1..142: mol_type = other RNA; note = Related to NZ_LT727777.1; note = Oceanobacillus iheyensis
atacgtgtggcaagattttattgcttgtgtttcgcaagtattgactcaaatggtggaaacatttgctactcggataggttgacggtgagtagtatactagttggctacttgtctgcttcgcataatgagttgccacacgtat

SEQ ID NO: 15283 - RNA, 129 nt, unidentified
  source 1..129: mol_type = other RNA; note = Related to JAJCRR010000003.1; note = Lachnospira pectinoschiza
atgcgtgtggctagatttttggcttgtgtttcgcaagctttgatggaaatggtaggaggatttgcagaaatatacgcccttccgtcctgtgtataaagggaaaaatgcataatgagtagccacacgctt

SEQ ID NO: 15284 - RNA, 126 nt, unidentified
  source 1..126: mol_type = other RNA; note = Related to JAFTZX010000234.1; note = Lachnospiraceae bacterium
atgcgtgtggctagattttttgcttgtgtttcgcaagtgttgatagcaatggtggggagactcgcacacattaatcgatactattcgatgtaatccgtttaggtgataatgagtagccacacgcaa

SEQ ID NO: 15285 - RNA, 140 nt, unidentified
  source 1..140: mol_type = other RNA; note = Related to NZ_FNYT01000006.1; note = Trichococcus ilyis
acgcgtgtggttagatttttggcttgtgcttcgcaagccttgactcaaatggtggtaagatttgcttatcctatgagcatccttgattatccgtatactattgcacaatatgcttttgcataatgagttgccacacgctt

SEQ ID NO: 15286 - RNA, 145 nt, unidentified
  source 1..145: mol_type = other RNA; note = Related to NZ_WIQQ01000012.1; note = Pectinatus frisingensis
cagcgtgcggttagattttgggcttgtgtttcgcaagctttgagaaaaatggtagagagactagctactatattcgtttttaaagttgtccattgttatttcttggtaataactatgttttagcataatgagtagccgcacgcaa

SEQ ID NO: 15287 - RNA, 143 nt, unidentified
  source 1..143: mol_type = other RNA; note = Clostridia bacterium; note = Related to SAAV01000006.1
gagcgtgtggtaagattttgtgcttgtgtttcgcaagtgttgactaaaatggtagagtcgtttgctctcatccatgttgccgtattatgcaatatgtgttctagtgttcagtgtagcattgcttaatgagttgccacacgctc

SEQ ID NO: 15288 - RNA, 129 nt, unidentified
  source 1..129: mol_type = other RNA; note = Related to KE136354.1; note = Enterococcus dispar
tagtgtgtggctagattttgtacttgtgtttcgcaagttttgacaaaattgctagggagaatagccttagtaatccgcaatttatgatcctttttctacgcagtgggcctaatgagtagccacgcacga

SEQ ID NO: 15289 - RNA, 173 nt, unidentified
  source 1..173: mol_type = other RNA; note = Related to NZ_MPSN01000002.1; note = Ligilactobacillus murinus
taacatgcgactagattttggacttgtgcgttcgcaagtattgattaaaatggggggacgatttgcctcattcatcgaccgtaagaaaagaattaatcatatgggtcatgccaattatcggttactgtataaatgtaagctatattggtggcataatgagtagtcgcatgttt

SEQ ID NO: 15290 - RNA, 131 nt, unidentified
  source 1..131: mol_type = other RNA; note = Related to NZ_NGLI01000001.1; note = Enterococcus sp.
ttgcgtgtggctagattttgtacttgtgtttcgcaagtattgattaaattgctagggacaatagccagtaggtataagggtgtttaacctttttcttcgcatatttcagcctaatgagttgccacacgctt

SEQ ID NO: 15291 - RNA, 130 nt, unidentified
  source 1..130: mol_type = other RNA; note = Related to JAARYB010000009.1; note = Listeria booriae
atgcgtgtggctagattattgatatgtgtttcgcatatcttgagaaaatggctgggaaggaaagctactattcgaaacgcgtctatagcgttttgcctctgtgttttgcctagtgagttgccacacgcta

SEQ ID NO: 15292 - RNA, 136 nt, unidentified
  source 1..136: mol_type = other RNA; note = Related to CP022488.1; note = Enterococcus faecalis
tggcgtgtggctagattttgtacttgtgattcgcaagttttgattaaaatgttggtagctatagctattagacagcctttaagtatataagcaatcttttatgctagtgtcgtgcctaatgagttgccacatgcta

SEQ ID NO: 15293 - RNA, 130 nt, unidentified
  source 1..130: mol_type = other RNA; note = Related to NZ_CP011102.1; note = Listeria weihenstephanensis
atgcgtgtggctagattttgcacttgtgattcgcaagttttgattaaatagctgggaattctagcttctttgtactatatttttcagcaattttctacgctgaatgagcctaatgagttgccacacgcta

SEQ ID NO: 15294 - RNA, 143 nt, unidentified
  source 1..143: mol_type = other RNA; note = Related to NZ_MAEJ01000004.1; note = Enterococcus sp.
gtgcgtgtggcaagattttttgacttgtgtttcgcaagttatgacaaaaagggtagctagtaagcatgcctccaataccatagcgacaatatataatgagttgtttaccgaccatgcttcgcataatgagttgccacacgctt

SEQ ID NO: 15295 - RNA, 142 nt, unidentified
  source 1..142: mol_type = other RNA; note = Related to NRQF01000015.1; note = Carnobacterium divergens
tggcgtgtggctagattttgtacttgtgcttcgcaagtattgacaaaaatggtaggaagtttagctgtcatcaatagttatttgagcattgggaaatatatctgctcagcattttagaggcctaatgagttgccacacgctt

SEQ ID NO: 15296 - RNA, 151 nt, unidentified
  source 1..151: mol_type = other RNA; note = Related to NZ_NFIW01000013.1; note = Megamonas hypermegale
aagcgtatggttagattgtggacttgtgtttcgcaagtattgaaataaaaggtaagtatacaagctgccttcatgtaaactatttagggcgtataagtttatataaagcttatctatcttaatgtattgcgtaatgagtaaccatacgcat

SEQ ID NO: 15297 - RNA, 152 nt, unidentified
  source 1..152: mol_type = other RNA; note = Related to CP024698.1; note = Fusobacterium sp.
atgtgtgtggttagattttttacttatgtttcgtaagtattgactaaaatgttagaaagttttgctaatgttgtgcaaattactcatagcttcatctaacttaataattctatttattatatttaaatcgcttaatgagttgccacacactt

SEQ ID NO: 15298 - RNA, 156 nt, unidentified
  source 1..156: mol_type = other RNA; note = Related to NZ_CP068114.1; note = Fusobacterium canifelinum
aagcgtgtggttagattttttacttatgcaattcgtaagtatttactaaaatgttagggcattttgctctaatagtatgctaacttaattagcttcatttgactaattctattattatcattaatttgatatcgcttaatgagttgccacacgctt

SEQ ID NO: 15299 - RNA, 140 nt, unidentified
  source 1..140: mol_type = other RNA; note = Clostridia bacterium; note = Related to JAGAAC010000102.1
aggcgtgtggttagattctgcgcttgtgtttcgcaagtgttgactaaaatgttatgacttgattctctttagcactgtatgatttaagcgcttattcaggcggttacagttcataatgcataatgagtaaccacacgcct

SEQ ID NO: 15300 - RNA, 129 nt, Bacillus sp.
  source 1..129: mol_type = other RNA; note = Related to NVHA01000086.1; note = Bacillus toyonensis
gaatgtgtggttagattttttaacttgtgcttcgcaagttttgacaaaaatggtaggaagacttgtttccgcctcgtagtgtaccgatattaatcgatcctgtagaacgtaatgagtaaccacacgttc

SEQ ID NO: 15301 - RNA, 130 nt, Bacillus sp.
  source 1..130: mol_type = other RNA; note = Related to NTTM01000084.1
gaatgtgtggttagattttttaacttgtgcttcgcaagttttgacgaaaatggtaggaagacttgttttccgcctcgtagtgtaccgatagttatcgatcctgtagaacgtaatgagtaaccacacgttc

SEQ ID NO: 15302 - RNA, 134 nt, unidentified
  source 1..134: mol_type = other RNA; note = Related to NZ_CP071798.1; note = Sporosarcina sp.
taacgtgtggttagattttttaacttgtgcttcgcaagttttgacaaaaatggtggggatacttgtttccgcctcatattctaatatacgataacgtatatatcctgaggaacgtaatgagtaaccacacgttc

SEQ ID NO: 15303 - RNA, 135 nt, unidentified
  source 1..135: mol_type = other RNA; note = Related to JPUW01000004.1; note = Lysinibacillus sp.
taacgtgtggttagatttttaacttgtgcttcgcaagttttgacaaaaatggtagggagatttgttccttattcatcatataattgtaccgtatggtgccgattcctatagaacgtaatgagtaaccacacgttc

SEQ ID NO: 15304 - RNA, 129 nt, unidentified
  source 1..129: mol_type = other RNA; note = Related to VHRP01000005.1; note = Enterococcus faecalis
aaacgtgtggttagatttttgacttgtgattcgcaagttttgacaacaatggtaggaagttttgtttccttatatatcatgcacaatggtacctgtaccctatagaacgtaatgagtaaccacacgttc

SEQ ID NO: 15305 - RNA, 143 nt, unidentified
  source 1..143: mol_type = other RNA; note = Related to NZ_CP046022.1; note = Enterococcus faecalis
ggacgtgtggttagatttttgacttgtgattcgcaagttttggcaataatggtagagtggtttgttctctgtactccataacaaaggtttccggagtaaccgtcggatacctataaaagaacgtaatgagtaaccacacgttc

SEQ ID NO: 15306 - RNA, 129 nt, unidentified
  source 1..129: mol_type = other RNA; note = Related to CP076644.1; note = Listeria monocytogenes
agacgtgtggttagattttcaacttgtgtttcgcaagttttgataaaaacggtagaaagacttgttcattagccttactgtaccataggcgctattgcctataaaacgtaatgagtaaccacacggtct

SEQ ID NO: 15307 - RNA, 141 nt, Bacillus sp.
  source 1..141: mol_type = other RNA; note = Related to NZ_CP009684.1; note = Bacillus subtilis
gaacgtgtggttagattttttaacttgtgtttcgcaagttttgacaaaaatggtagggagatttgttccttattactcgtataattgtattgtatcgtatagtttcgattcctatagaacgtaatgagtaaccacacgttc

SEQ ID NO: 15308 - RNA, 131 nt, unidentified
  source 1..131: mol_type = other RNA; note = Related to NZ_PYWN01000149.1; note = Metasolibacillus meyeri
gaatgtgtggttagattttcaacttgtgtttcgcaagttttgacaaaaatggtagggagatttgttccttattcatcataatgtaccgtatggtgcagattccttagaacgtaatgagtaaccacacgttc

SEQ ID NO: 15309 - RNA, 136 nt, unidentified
  source 1..136: mol_type = other RNA; note = Related to JAARXI010000004.1; note = Listeria booriae
aagcgtgtggctagattttttacttatgattcgtaagtattgactaaattggcagaatcaattgctgcatttattagcctgtctcaattttgcatatccgtgttgcatattgcgcataatgagttgccacacgcct

SEQ ID NO: 15310 - RNA, 137 nt, unidentified
  source 1..137: mol_type = other RNA; note = Related to NZ_KE386795.1; note = Veillonella magna
agacgcatgagaagattttttgcttgtgattcgcaagcattgacaaaaaagtgcacatcgcgcttctgtgccaaattaatgatactcaatagtttatgagtagtttatagtttagcctaatgagttctcgtgcgtct

SEQ ID NO: 15311 - RNA, 144 nt, unidentified
  source 1..144: mol_type = other RNA; note = Related to NFKI01000003.1; note = Pseudoflavonifractor sp.
gagcgtgtggcaagattttgtacttgtgtttcgcaagtgttgaccaaactgggtggtgctttagcgtattgccctttcccgttatgatgttaacatgttcatcatgttgactaatccgtccgcataatgagttgccacacgctc

SEQ ID NO: 15312 - RNA, 145 nt, unidentified
  source 1..145: mol_type = other RNA; note = Related to JAGZJF010000013.1; note = Oscillospiraceae bacterium
gagcgtgtggcaagattttgtacttgtgtttcgcaagtgttgaccaaactgggtggtgctttagcgtattgccctttcctgccatgatgttactcgtgttcatcatgttgactaatccgtccgcacaatgagttgccacacgctc

SEQ ID NO: 15313 - RNA, 146 nt, unidentified
  source 1..146: mol_type = other RNA; note = Related to NZ_JACOEA010000001.1; note = Intestinimonas sp.
gagcgtgtggcaagattttgtacttgtgtttcgcaagtgttgactaaactgggtggcgctttagcgtattgcccttccctgccatgatgttactcgtgttagctcatgtcgacttgtcctttcgcacaatgagttgccacacgctc

SEQ ID NO: 15314 - RNA, 146 nt, unidentified
  source 1..146: mol_type = other RNA; note = Related to QUKQ01000046.1; note = Ruminococcaceae bacterium TF06-43
gagcgtgtggcaagattttgtacttgtgtttcgcaagtgttgactaaactgggtggcacattagcgtattgccctttctttccatgatgttaactgtgttaactcatgttgactgatcctttcgcacaatgagttgccacacgctc

SEQ ID NO: 15315 - RNA, 149 nt, unidentified
  source 1..149: mol_type = other RNA; note = Related to NZ_CP035283.1; note = Caproiciproducens sp.
tagcgtgtggcaagattttgtgcttgtgtctcgcaagcgttgataaaaatggtaggcacgtttgcttatcactctatttctacatgttgtacgctgatagtatcgctgtacatcatgcatcatcccgcataatgagttgccacacgctt

SEQ ID NO: 15316 - RNA, 147 nt, unidentified
  source 1..147: mol_type = other RNA; note = Related to JAGAWV010000307.1; note = Acidaminococcaceae bacterium
aaacgtgtggcaagattttgagcttgtgtttcgcaagctttgacgaaaatggtgcattagcgtctatcagctgttgaccgtccttgtgttatgcgatgtaagcttgttctgttcgcacactcttgcataatgagttgccacacgttt

SEQ ID NO: 15317 - RNA, 133 nt, unidentified
  source 1..133: mol_type = other RNA; note = Firmicutes bacterium; note = Related to JAHAER010000020.1
aagcgtatggcaagattttttgtttgtgtttcgcaaacattgattaaacggatagagcatttgctggatttattacaaccagaagagaaacggacagagcgacgttttcagcctaatgagttgccatacgctt

SEQ ID NO: 15318 - RNA, 132 nt, unidentified
  source 1..132: mol_type = other RNA; note = Related to JAAYIN010000072.1; note = Clostridiales bacterium
aagcgtgtggcaagattttgtacttgtgtttcgcaagtgttgataaaaatggttgggggaattgcctaaatcaaatgccgctgacgatcaaacaaaactaaatgcttcggcataatgagttgccacacgcct

SEQ ID NO: 15319 - RNA, 145 nt, unidentified
  source 1..145: mol_type = other RNA; note = Related to JAJCJJ010000005.1; note = bacterium 210917-DFI.7.65
aagcgtgtggcaagatcatgtgcctgtgtttcgcaagcgttgacgaaaatgccggggagatttgcttccttgtatcattttcctgcataaaacagcagaaaacaatgagggctggtgtgctcgcgtaatgagttgccacacgctt

SEQ ID NO: 15320 - RNA, 131 nt, unidentified
  source 1..131: mol_type = other RNA; note = Related to SVGI01000005.1; note = Clostridiales bacterium
aagcgcatggcaagattttgtgcttgtgtttcgcaagtgttgacaaaaatgttcggggcatttgcttcgtcgtgcaatccctgaaaacctgtatacgcgtttgcgtttgcttaatgagttgccatgcgccc

SEQ ID NO: 15321 - RNA, 130 nt, unidentified
  source 1..130: mol_type = other RNA; note = Siphoviridae sp.; note = Related to BK026599.1
aagcgtatggcaagatttttggcttgtgtttcgcaagcgttgactaaaatggtgggagcatttgcgtctttccatgcttcgtcgcctctttaatctctgtaaatttcgcataatgagttgccatacgctg

SEQ ID NO: 15322 - RNA, 132 nt, unidentified
  source 1..132: mol_type = other RNA; note = Related to NZ_NFJU01000007.1; note = Proposed Anaeromassilibacillus sp.
gagcacatggcaagattttgtactcgcggatcgcgggtgttgactaaaatggtggggactttagccctttatcattctttaatcgtaaacagggatagatacttttgctgcataatgagttgccatgtgctc

SEQ ID NO: 15323 - RNA, 134 nt, unidentified
  source 1..134: mol_type = other RNA; note = Oscillospiraceae bacterium; note = Related to BQOK01000001.1
gagcacatggcaagattttgtactcgcgtatcgcgagtgttgactaaaatggcaggggagttggctcctccatccgtttggccgttacccatacaaagagagaatctttttgcataatgagttgccatgtgctc

SEQ ID NO: 15324 - RNA, 134 nt, unidentified
  source 1..134: mol_type = other RNA; note = Candidatus Gemmiger stercorigallinarum; note = Related to DWWX01000035.1
gagcatatggcaagattttgtactcgcgcatcgcgggtgttgactaaaatggcaggaagtttagctctcctccatcatttcggcggtacagttgtaatcctggtcctccacgcataatgagttgccatgtgctc

SEQ ID NO: 15325 - RNA, 130 nt, unidentified
  source 1..130: mol_type = other RNA; note = Related to NZ_JHVL01000054.1; note = Clostridiisalibacter paucivorans
ttgcgtgtggctagagttttttgcttgtgtttcgcaagtattgataaaaaggttgggaatattcgcaactttctggctgtactattttaccacgtaatacatgttgtgcataatgagtagccacacgcaa

SEQ ID NO: 15326 - RNA, 148 nt, unidentified
  source 1..148: mol_type = other RNA; note = Related to JAFVVV010000369.1; note = Clostridia bacterium
gagcatatggcaagattttgggcttgtgtttcgcaagcgttgactaaaatggtaggggacttttgctctatcatcattttttgaaatggcttttatgtgtcttgatggcacttgtaccatttcgagcgtaatgagttgccatatgctc

SEQ ID NO: 15327 - RNA, 148 nt, unidentified
  source 1..148: mol_type = other RNA; note = Related to JAFYAQ010000001.1; note = Oscillospiraceae bacterium
gagcgtgtgacaagattttgggcttgtgtttcgcaagctttgattaaaatggtagatggatttgctatctatcgtcatttccagtactgttatgtttatgttctgtttacccgtatgcaccatccgcataatgagttgtcacacgctc

SEQ ID NO: 15328 - RNA, 144 nt, unidentified
  source 1..144: mol_type = other RNA; note = Related to ABABDZ010000001.1; note = Clostridium perfringens
tagtgtgtggctagattttttgcttgtgtttcgcaagtattgattttaatggtaggaacttttgctatcatctagattttagctagtatagctttattttagctagtaaaaattgcttttagcataatgagttgccacacacct

SEQ ID NO: 15329 - RNA, 126 nt, unidentified
  source 1..126: mol_type = other RNA; note = Related to AACDFA010000001.1; note = Campylobacter lari
catagcatgataagattttttatttgtgtttcgcaaatattgacaaaaaagttatgttattatctaaataatcttagcttcatttttatcatcaatatttctgatgtaatgagttatcatgctatt

SEQ ID NO: 15330 - RNA, 144 nt, unidentified
  source 1..144: mol_type = other RNA; note = Related to NZ_FYBR01000008.1; note = Listeria sp.
aagcgtgtggctagattttgtacttgcgcttcgcaagtgttgattaaaagggtggcagtatttgcagcttctgcatccccttctcaaaatgatgtgcggccgttgcatatgattgttcattgcgtaatgagtagccacacgcga

SEQ ID NO: 15331 - RNA, 151 nt, unidentified
  source 1..151: mol_type = other RNA; note = Related to JACVVC010000001.1; note = Enterococcus sp.
tgacatgtggctagattttttggcttgtgattcgcaagtcttgactaaaatggtgggcagatttgctggcttatcaacttaccggttagactctttgtgtaattgtattaaggagtttatgctatttcgcgtaatgagtagccacatgttt

SEQ ID NO: 15332 - RNA, 143 nt, unidentified
  source 1..143: mol_type = other RNA; note = Related to QPVP01000009.1; note = Enterococcus faecium
agacgtgtggctagattttgggcttgtgtttcgcaagcgttgactaaaatggtagggagttttgcttactgtacaatatacccgttgtattatttgcaactgtatggatcttcatgcttcgcataatgagtagccacacgttt

SEQ ID NO: 15333 - RNA, 145 nt, unidentified
  source 1..145: mol_type = other RNA; note = Related to NZ_CP042833.1; note = Enterococcus faecium
aaacgtgtggctagattttgggcttgtgtttcgcaagcattgactaaaatggtaggaagttttgctaacttatcaaattacattatatacattggtatcaacggtattacactctctgcttcgcataatgagtagccacacgttt

SEQ ID NO: 15334 - RNA, 144 nt, unidentified
  source 1..144: mol_type = other RNA; note = Related to NZ_MCRG01000029.1; note = Enterococcus mundtii
agacgtgtggctagattttgtacttgtgtttcgcaagtattgacaaaaatggtaggaagttttgcttattacaaacatcccttagacaagtatggggagcttttaaagtatgcttaaattcgcataatgagtagccacacgtta

SEQ ID NO: 15335 - RNA, 142 nt, unidentified
  source 1..142: mol_type = other RNA; note = Related to JAKNTG010000011.1; note = Enterococcus hirae
agacgtgtggctagattttgtacttgtgtttcgcaagtattgactaaaatggcaggaaattttgctatctctgaaagatgcagcagagaaaataagggatcttatacatgcttgaatacgcataatgagtagccacacgtta

SEQ ID NO: 15336 - RNA, 137 nt, unidentified
  source 1..137: mol_type = other RNA; note = Related to NZ_CP063383.1; note = Listeria monocytogenes
aagcgtgtggctagattgtgtacttgtgtttcgcaagtattgactaaaacggtgggaactttgctcacctctaaacttacctgctaaaagtaatacaggagtaacgtgcgccctgcgtaaggagtagccacacgtat

SEQ ID NO: 15337 - RNA, 151 nt, unidentified
  source 1..151: mol_type = other RNA; note = Related to RKEI01000021.1; note = Clostridiales bacterium
aagcgtgcagcaagattttgtgcttgtgtttcgcaagtgttgacaagaacggtgagaagattcgctctcatgtcacctgtttatccctattaactttttgtgtagcttatagttatatacatatttccgcataatgagttgccgcacgctt

SEQ ID NO: 15338 - RNA, 131 nt, unidentified
  source 1..131: mol_type = other RNA; note = Oscillospiraceae bacterium; note = Related to JAFXUW010000045.1
tggcgtgtggcaagattttttgcttgtgtttcgcaagcattgacaaaaacggtaggttcgtttgccttccattccatggcgtccatgactcgcctgcagctattatcggcataatgagttgccacacgcca

SEQ ID NO: 15339 - RNA, 123 nt, unidentified
  source 1..123: mol_type = other RNA; note = Related to NZ_LIWN01000009.1; note = Campylobacter mucosalis
aagtatgtggctagattttttacttgtgtttcgcaagtattgactaaaatatagcaaaacttttgctactacatctttagcatatattaatagagcatgtgcttaatgagttgccacatacga

SEQ ID NO: 15340 - RNA, 116 nt, unidentified
  source 1..116: mol_type = other RNA; note = Related to RBJN01000156.1; note = Campylobacter sp.
agatgtgtggctagattttgtgtttgtgtttcgcaaacgttgactaaaatgttggcaaactttgctacatgcttacaataatgcaattattttgtataatgagttgccacacattc

SEQ ID NO: 15341 - RNA, 124 nt, unidentified
  source 1..124: mol_type = other RNA; note = Related to NZ_CP060707.1; note = Campylobacter concisus
taaggcgtagctagattttgtacttgtgtttcgcaagtattgactaaaatgttatagaggtttttatctacatcagcatattaatacatagcatcttatgcacttaatgagtggctacgccgat

SEQ ID NO: 15342 - RNA, 143 nt, unidentified
  source 1..143: mol_type = other RNA; note = Clostridia bacterium; note = Related to JAFRHU010000008.1
tgacgtgtggcaagatcttgtacttgtgtttcgcaagtattgactaaaatggtagggctatttgcttatcatcttcattggcattatggccaaacgaccgggattttcccgagacttttcgcataatgagttgccacacgtca

SEQ ID NO: 15343 - RNA, 142 nt, unidentified
  source 1..142: mol_type = other RNA; note = Clostridia bacterium; note = Related to JAFWMS010000015.1
agacgtgtggcaagatcctgtacttgtgtttcgcaagtattgactaaaatggtagggttatttgttctatatctctattattctatatggcaatgctctggtagtctgccgagatcttcgcataatgagttgccacacgtca

SEQ ID NO: 15344 - RNA, 142 nt, unidentified
  source 1..142: mol_type = other RNA; note = Related to JAFZIH010000156.1; note = Clostridia bacterium
tgacgtgtggcaagatcttgtacttgagtttcgcaagtattgactaaaatggtagggcttttgctcttcatctgcgttagcattgtggccattgaaccgggattctcccgagtcattttgcataatgagttgccacacgtca

SEQ ID NO: 15345 - RNA, 129 nt, unidentified
  source 1..129: mol_type = other RNA; note = Related to JAGFBC010000073.1; note = Schleiferilactobacillus harbinensis
ttgcgtatgactagaattttggcttgtgtttcgcaagtcttgacatgaatggtaggttggattggcagttttacacagggttctcccaaaacggtgggcgctttgcgcgtaatgagtagtcatacgcgc

SEQ ID NO: 15346 - RNA, 127 nt, unidentified
  source 1..127: mol_type = other RNA; note = Related to JAHADJ010000026.1; note = Dialister sp.
aagcatgtgacaagattttttacttgtgtttcgcaggtatttatagcaatggtaggagcaatagcgcttccataagtttcactactgagagtctcagattctctgcataatgagttgtcacatgctt

SEQ ID NO: 15347 - RNA, 137 nt, unidentified
  source 1..137: mol_type = other RNA; note = Related to SCPI01000001.1; note = Dialister invisus
aagcatgtggcaagattttgtgcttgtgcttcgcgagcattgcaaataatggttggtgtattggcttgtcttcctggtgaatttttgtttttgtgagttcctcagggattatccgcgtaatgagttgccacatgctt

SEQ ID NO: 15348 - RNA, 129 nt, unidentified
  source 1..129: mol_type = other RNA; note = Related to CP016202.1; note = Eubacterium minutum
atgcgtgcggttggatttttcgcttgtgtttcgcaagtgttgattaaaatgttagggtcaattgcgttttgcttttgatcgacttcttctaaacttttgttgctatgcataatgagcaaccgcacgtac

SEQ ID NO: 15349 - RNA, 138 nt, Staphylococcus sp.
  source 1..138: mol_type = other RNA; note = Related to CP009676.1; note = Staphylococcus schleiferi
ttaagcgtggctagattttgtggttgtgtttcgcaatcgttgaatttattgtaagagtatgttgcttcttatatttttaagtttgtaatattcagaagtttagctttagtattacgcctaatgagtagccacgccttt

SEQ ID NO: 15350 - RNA, 140 nt, Staphylococcus sp.
  source 1..140: mol_type = other RNA; note = Related to CP022056.2; note = Staphylococcus saprophyticus
gtaagcgtggctagattttgtggttgtgtttcgcaaccattgcacttattgcaaggagtgactgcttcttgtaattttcagctcataatattcaggaatttagctttggtatttctcgcctaatgagtagccacgccttt

SEQ ID NO: 15351 - RNA, 144 nt, unidentified
  source 1..144: mol_type = other RNA; note = Related to NZ_JACSMB010000004.1; note = Exiguobacterium sp.
agacgtgtggttagattttttgcttgtgtttcgcaagcattgacataaatggtaggagtattagcgatatatttctccgcttttctctgctgttaacattagcttttcgatgagtttagccgcataaggagtaaccacacgtct

SEQ ID NO: 15352 - RNA, 148 nt, unidentified
  source 1..148: mol_type = other RNA; note = Clostridia bacterium; note = Related to JAFPWD010000023.1
aaacgtgcggcaagattttgtacttgtgtctcgcaagtattgacgaaaacggtaggaggactagcgccttcacattactggtattgcattggattgcattgcattgaggtgcgattcgactgcgcgcggaatgagttgccgcacgttt

SEQ ID NO: 15353 - RNA, 145 nt, unidentified
  source 1..145: mol_type = other RNA; note = Related to JAFVFJ010000126.1; note = Eubacterium sp.
tgatgcatggcaagattttgtactagtgtttcgctagcattgactaacttgtaaggagacatatctgctgtttacaatcttttatcgcaatatatgttttacatacgaatgtaatactttacgcataatgagttgccatgcatcg

SEQ ID NO: 15354 - RNA, 136 nt, unidentified
  source 1..136: mol_type = other RNA; note = Related to CP033618.1; note = Lactiplantibacillus plantarum
atgggtgggactagattattggccgatgattcgtcggtcttgctttgaatggtatgagctttctctaattgttaacactgtactagcctgtaaaaatttccggctgtcgcagtagacaatgagtagtcccatcctt

SEQ ID NO: 15355 - RNA, 137 nt, Streptococcus sp.
  source 1..137: mol_type = other RNA; note = Related to WTXU01000099.1; note = Streptococcus thermophilus
atgggtggggctagattattgaccgatgattcgtcggccttgcatcaaatggtacgagctttctctgactgttaacaaatgtgttagcctgttaacttttccggctgtcgcataagataatgagtagccccatcttt

SEQ ID NO: 15356 - RNA, 138 nt, unidentified
  source 1..138: mol_type = other RNA; note = Related to VHJC01000059.1; note = Lactiplantibacillus plantarum
atgagtggggctagatttttgatcgatgattcgtcgattttgcaaaaaatggtagggactttctatagaaatgttgtctaaatgtatcataggtggacgtttccagctgtcgcttagataatgagtagccccattctt

SEQ ID NO: 15357 - RNA, 153 nt, unidentified
  source 1..153: mol_type = other RNA; note = Related to JXDF01000031.1; note = Apilactobacillus kunkeei
tggtataagatcagattatgtgctcgtgattcgcgagttttgaccaaattggtggggggtgtccccttctactaactttagcttccaaatttacttgtaagcaggtgtacctgtaaactgaggggcgctgtcgaaatgagtgatcttatactt

SEQ ID NO: 15358 - RNA, 159 nt, Streptococcus sp.
  source 1..159: mol_type = other RNA; note = Related to JAJEOY010000010.1; note = Streptococcus sanguinis
atacgtatggctagatttttgacttatgattcgtaagtttttaactaagggtagctagattttgcctttcttatcgataaacagaagagaatttttaaattattcaacactgttttatgcagattcgactgcgtcggcatagtgagttgccatacgttt

SEQ ID NO: 15359 - RNA, 153 nt, Streptococcus sp.
  source 1..153: mol_type = other RNA; note = Related to NZ_CZFC01000010.1; note = Streptococcus suis
atacgtatgattagattttgacttatgtttcgtaagtttttatgttaagggtaggagtttttgcctttctattgcttagccgaaaaagtagtcagtttagaatctgctgaaggttaagcagaccgcgtcggcgtaatgagttatcatacgttt

SEQ ID NO: 15360 - RNA, 194 nt, Streptococcus sp.
  source 1..194: mol_type = other RNA; note = Related to NZ_AP024276.1; note = Streptococcus parasuis
gtgcgtatgattagatttttgacttgtgtgttcgcaagaattaacaaaaaggttacacggtgtttagctcactcaagtgccccttcagagaaacgaaagtcaatccattagtggaataaatgtttatagtagtttttaggctattttcggaattattttcatactttcgttcgcgtaagagttttcatacgctt

SEQ ID NO: 15361 - RNA, 193 nt, Streptococcus sp.
  source 1..193: mol_type = other RNA; note = Related to NZ_KB904582.1; note = Streptococcus ovis
ttgcgtatgattagatttttgacttgtgtgttcgcaagtattaacttcaatgttagaagagtgttcagctcactccagtatttccgcttaaggaaatagaatttcagcacctgagaaaattgttttaatagtatctttagctatttcggaattattctagtactgtcgttcgcataggagtaatcatacgctt

SEQ ID NO: 15362 - RNA, 195 nt, Streptococcus sp.
  source 1..195: mol_type = other RNA; note = Related to NZ_AQYA01000033.1; note = Streptococcus henryi
acgcgtatgattagatttttgacttgtgtgttcgcaagtattagcgataatgggtatggtagtgtttagctcactccagtatatctacttagagaaatcgaatgtcagctactaagaaaactgtattagtagaagccgtaaactatttcggaagtatttctttactgtcgttcgcataagagttttcatacgctt

SEQ ID NO: 15363 - RNA, 193 nt, Streptococcus sp.
  source 1..193: mol_type = other RNA; note = Related to RQZA01000003.1; note = Streptococcus minor
atgcgtatgattagatttttgacttgtgtgttcgcaagtattaacttcaatgttagaagagtgttcagctcactccagtatttccgcttaaggaaatagaatttcagcacctgagaaaattgttttaatagtatctataactatttcggaattattcttttactgtcgttcgcataggagtaatcatgcgctt

SEQ ID NO: 15364 - RNA, 167 nt, Streptococcus sp.
  source 1..167: mol_type = other RNA; note = Related to NZ_CP075172.1; note = Streptococcus equinus
atgcgtatgattagatttttgacttgtgtgttcgcaagtattaataacaatgttaggagagcgtttagcgcactttagtacattcttttgaaaacgtatcagtaggataaaaaatcgtggtggttaagagtattactgtcgttttgcgtaagagttttcatacgctt

SEQ ID NO: 15365 - RNA, 194 nt, Streptococcus sp.
  source 1..194: mol_type = other RNA; note = Related to AP010655.1; note = Streptococcus mutans
atgcgtatgattagatttttgacttgtgtgttcgcaagtattaacgacaatgttacgggagcgtttagttcgctccagtatacctttcaaaaaccatagtatacaatcagctgagaaaactttcttagcaatgtctgttgcccggttaggaatgatccatttactgtcgttcacgtaggagttttcatacgctt

SEQ ID NO: 15366 - RNA, 198 nt, Streptococcus sp.
  source 1..198: mol_type = other RNA; note = Related to CABHMZ010000033.1; note = Streptococcus constellatus
ttgcgtatgattagatttttgacttgtgtgttcgcaagtattaacgacaatgttataagagtgtctagctcactccagcattcccgcttaagaggaaggatagggatgactgctgctggaaaaaattcttagtgttatttattttaccattcggaattattctattgctgtcgttcgcctaagagttatcatacgctt

SEQ ID NO: 15367 - RNA, 190 nt, Streptococcus sp.
  source 1..190: mol_type = other RNA; note = Related to NCUE01000019.1; note = Streptococcus oralis
ttgcgcatgattagatttttgacttgtgtgttcgcaagtattaacaaaaatgttactagagtgttcagctcactccagtaatcccaaaactaagacaattaagtttcttctggaaaaagttgcagtatgttttatctctgctgaaggaagatttctatactgtcgttcgcataagagttttcatgcgctt

SEQ ID NO: 15368 - RNA, 190 nt, Streptococcus sp.
  source 1..190: mol_type = other RNA; note = Related to JYGT01000002.1; note = Streptococcus infantis
ttgcgcatgatcagatttttgacttgtgtgttcgcaagtattaacaaaaatgttaccagagtgttcagctcactccagtaatcccaaaactaaggcaaataggcttcttctggaaaaagttgcagtatgttttatctctgctaaaggaagatttctatactgtcgttcgcataagagttttcatgcgctt

SEQ ID NO: 15369 - RNA, 148 nt, Streptococcus sp.
  source 1..148: mol_type = other RNA; note = Related to NTGM02000001.1
ttgcgtatgattagatttttgacttgtgtgttcgcaagtattaacaacaatgttataggagtgtttggcttcatctggtgttattagcttcaggattcattaggatttctactggcaatcttgttcgcgtaagagttatcatacgctt

SEQ ID NO: 15370 - RNA, 190 nt, Streptococcus sp.
  source 1..190: mol_type = other RNA; note = Related to NZ_CP066059.1; note = Streptococcus oralis
ttgcgtatgattagatttttgacttgtgtgttcgcaagtattaacaaaaatgttactagagtgttcagctcactccagtaatcccaaaactaaggcaattagatttcttctggaaaaagttgcagtatgttttatctctgctgaaggaaggtttctatactgtcgttcgcataagagttttcatgcgctt

SEQ ID NO: 15371 - RNA, 193 nt, Streptococcus sp.
  source 1..193: mol_type = other RNA; note = Related to NZ_LR134002.1; note = Streptococcus sanguinis
tagcgcatgattagatttttgacttgtgtgttcgcaagtattaagagcaatgttactagagtgttcagctcactccagtaatttccgacaatagtgacagttagattttttcgagaattattcccaactttcatcaattgaagtcttaggaagatttctatactgtcgttcgcataagagttttcatgcgctt

SEQ ID NO: 15372 - RNA, 193 nt, Streptococcus sp.
  source 1..193: mol_type = other RNA; note = Related to CDMW01000001.1; note = Streptococcus sanguinis
tagcgcatgattagatttttgacttgtgtgttcgcaagtattaagaacaatgttactagagtgttcagctcactccagtcatttccgacaatagtgacagttagattttttcgagaattattccaaactttcatcaattgaagtcttaggaagatttctatactgtcgttcgcataagagttttcatgcgctt

SEQ ID NO: 15373 - RNA, 183 nt, Streptococcus sp.
  source 1..183: mol_type = other RNA; note = Related to NZ_OU540596.1; note = Streptococcus salivarius
aagcgtatgattagatttttgacttgtgattcgcaagtaataatgaaaatgtgttgaaggtgtttagctcctccagtatatttcctattaagaaaaaatgaaaaagttcaggtgacttaaatgacatcagctgaaaagttggtatctgtatactgtcgtccgcgtaagagttttcatacgctt

SEQ ID NO: 15374 - RNA, 202 nt, Streptococcus sp.
  source 1..202: mol_type = other RNA; note = Related to NZ_RCVM01000028.1; note = Streptococcus hillyeri
ctgcgtatgattagatttttgacttgtgtgatcgcaagtattaacattaatgttagctgaaagttagctcactccagtatattctttgagagaattaaagttatctgctgagtgaaaatcgaagtgaaatgactggttaaggaaagctaagtaatttggtaatattctatactgtcgttcgcgtaagagttatcatacgctt

SEQ ID NO: 15375 - RNA, 195 nt, Streptococcus agalactiae
  source 1..195: mol_type = other RNA; note = Related to LR134265.1
atgcgtgtgaatagatttttgacttgtgtgttcgcaagtattaacaataatgttacaagagcgttttgctccctccagtagtcaataatgttcaattcgacaattgctgctgatgaatgataaactacatcaataggctgaactaattggctatatctgttttactgtcgttcgcttgagagttttcacacgctt

SEQ ID NO: 15376 - RNA, 164 nt, Streptococcus sp.
  source 1..164: mol_type = other RNA; note = Related to NZ_BCLE01000009.1; note = Streptococcus orisasini
atgcgtgtgactagatttttgacttgtgtgttcgcaagtattaacaacaaaggttggaatactttttcagcctctaatatctcaccaggaagactttcagctgagaaaacatctgtacttcccttaggccaactgcttttcgcataatgagttgtcacacgctt

SEQ ID NO: 15377 - RNA, 143 nt, unidentified
  source 1..143: mol_type = other RNA; note = Related to QSGD01000014.1; note = Holdemanella biformis
tagcacatgattagatatttggcttgtgtttcgcaagctttgaaaaaaatggtagcaaggttagcgattattctttacgcttaattactccttatttacttttattgtctttatttcaacgcataatgagtagtcatgtgctt

SEQ ID NO: 15378 - RNA, 132 nt, Streptococcus sp.
  source 1..132: mol_type = other RNA; note = Related to RJOU01000001.1; note = Streptococcus gordonii
gtgtgcatggctagatttttaacttgtgattcgcaagtaattaaagtaatgttatatgagtcttttagcatatagtatagctagacttaggtcagacatactaagcaacgcataatgagttgccatgcactt

SEQ ID NO: 15379 - RNA, 135 nt, unidentified
  source 1..135: mol_type = other RNA; note = Related to NZ_SCWC02000010.1; note = Macrococcus equipercicus
tatcatgtggctagatttttggtatgtgcttcgcataccttgaaaagaaaggcagggacatttgttacctgtacgcatcatcatctagtgggatagttggcaattggtataaacataatgagtagccacatgact

SEQ ID NO: 15380 - RNA, 143 nt, unidentified
  source 1..143: mol_type = other RNA; note = Related to JAHAAI010000002.1; note = Veillonella sp.
tagcgtatggttagattttttgcttgtgcttcacaagtattgatttatttatgaaggatgggagttttttctctctctgataaattctttagtaaatacattgggaatatcatgtgtttgagataaagagtaaccatacgctg

SEQ ID NO: 15381 - RNA, 156 nt, unidentified
  source 1..156: mol_type = other RNA; note = Related to JAHAFZ010000010.1; note = Veillonella parvula
tagcgtatggttagattttttacttgtgcttcacaagtgttgatataaatgttaggactcttatgtctctagagataatcttttatagatacagatgaattctttagtttaatacttttgtatttagacttttatataaagagtaaccatacgctt

SEQ ID NO: 15382 - RNA, 137 nt, unidentified
  source 1..137: mol_type = other RNA; note = Related to AWXD01000007.1; note = Peptoniphilus sp.
tagcgtgtggttagagtttttgcttgtgtttcgcaagcgttgatttaaatgtgaggtctgtttgtctcgctcgtcaattcctttttatttatatatgatttttgtatgaatttgacataaagagtaaccacacgctt

SEQ ID NO: 15383 - RNA, 135 nt, unidentified
  source 1..135: mol_type = other RNA; note = Related to NZ_ADFU01000011.1; note = Veillonella parvula
tagcgtatggttagagtttttgcttgtggttcgcaagcgttgaatttaatgtgagagttgctttcagctctcgatgattctttaataatttcatgtacacatgatgaatttgagataaagagtaaccatacgctt

SEQ ID NO: 15384 - RNA, 132 nt, unidentified
  source 1..132: mol_type = other RNA; note = Related to LTGD01000005.1; note = Anaerosphaera sp.
tagcgtatggttagattttttgcatgtgattcacatgcgttgtatttaatgttaggagcattagtcactaacaaacccattcataataatataagttatacttagatcgacctaaggagtaaccatatgctt

SEQ ID NO: 15385 - RNA, 136 nt, unidentified
  source 1..136: mol_type = other RNA; note = Related to NZ_ADFR01000009.1; note = Bulleidia extructa
gggcgtatggttagattttttacttgtgtttcacaagtgttgatttcaatgtgagatagataggtctttcaataaacctttgaaatgtatactgtaagttcagtatgctaataacctaatgagtaaccatacgtct

SEQ ID NO: 15386 - RNA, 151 nt, unidentified
  source 1..151: mol_type = other RNA; note = Related to JAEUGG010000004.1; note = Peptostreptococcus stomatis
ttgcgtatagctagatcttttacttgtgtttcgcaagtgttgcatttaatggttgatagattagccacacttaaactttttttccttctttcatttttttctttttttcctgaaaagatgaatgactggcataatgagtagctatacgctt

SEQ ID NO: 15387 - RNA, 151 nt, unidentified
  source 1..151: mol_type = other RNA; note = Related to JABZQL010000055.1; note = Mogibacterium diversum
aagcgtatagctagattttttacttgtggttcgcaagtagttttgtaaatggaacggggtttagcgatatccttgattcaaattttatcattaaagaaaaaatagtatgattgcatcaatgcttaattgcataatgagtagctatacgcat

SEQ ID NO: 15388 - RNA, 130 nt, unidentified
  source 1..130: mol_type = other RNA; note = Related to MNSF01000070.1; note = Coprococcus sp.
aggcgcatcgttagatttttgagttgtgtttcgcaattcttggtgaaaacggtagggagacttgccacccaataaaggatatatgcctgttttacccttattatagggcataatgagtagcgatgcgcct

SEQ ID NO: 15389 - RNA, 144 nt, unidentified
  source 1..144: mol_type = other RNA; note = Related to FMEJ01000011.1; note = Clostridium sp.
ttgtgcacggttagattttttactcatgtttcgtgagtattgacaagaacggtacgatatgtgctctttacgcgtctcccgaacactcacgctatacttttgggagattacgggttacactgcctaaagagtaaccgtgcacaa

SEQ ID NO: 15390 - RNA, 143 nt, Streptococcus sp.
  source 1..143: mol_type = other RNA; note = Related to FIHB01000001.1; note = Streptococcus suis
cgacatataactagaatttattgtttgtgtatccgcaaatagtgataaaattagctgggtaactagtcttgtttcttgcaactgaaaagtaacttatacttacaaaggctcgcaagactcgcatattgagtagttatatgtct

SEQ ID NO: 15391 - RNA, 143 nt, Streptococcus sp.
  source 1..143: mol_type = other RNA; note = Related to NZ_UHFV01000002.1; note = Streptococcus macacae
taacgtataactagaatttattgtttgtgtatccgtaaacaatgataaagtgaactgggcggctagtttgatttattgcaccggctgagaaatcgcttttatcaacgctcgacaagtctcgcataatgagtagttatatgttt

SEQ ID NO: 15392 - RNA, 141 nt, Streptococcus sp.
  source 1..141: mol_type = other RNA; note = Related to NZ_GL878548.1; note = Streptococcus sanguinis
tgacatataactagaatttattgtttgtgtatccgcaaattgtgatgaagtcaactgggtaactagtttaagatttcgcctgttgagaagcttgttcagaaaatgctcaacaagtctcgcatagtgagtagttatatgttt

SEQ ID NO: 15393 - RNA, 142 nt, unidentified
  source 1..142: mol_type = other RNA; note = Related to JAGZSC010000015.1; note = Clostridiaceae bacterium
ttgcgtgtggttggattatttggcttgtgtttcgcaagttttgacaaaaatggtgggaatgtacaccactctctatgttcagactggaggggcttcttaatatagtagttctcgaatggtgttaatgagcaaccacacgcct

SEQ ID NO: 15394 - RNA, 152 nt, unidentified
  source 1..152: mol_type = other RNA; note = Related to JAFUUI010000025.1; note = Ruminococcus sp.
gagcgtatgacaagattgttgtgctgtgcttcgcagtatcttgatgctatgtcagggcatccacgctttcgggcgtctctacagtacctataacaatttctgtattatttattgttatataccttttccgcctaatgagttgtcatgcgctc

SEQ ID NO: 15395 - RNA, 134 nt, unidentified
  source 1..134: mol_type = other RNA; note = Related to NZ_WQRC01000021.1; note = Anaerostipes hadrus
caacgtgtagttagattttgtgcttgtgtttcgcaagtattggcaaaaatggtaggaacatatgcgttcttttactatttaattagtcttggttagatgaacttagacaccgcataatgagtaactacacgtta

SEQ ID NO: 15396 - RNA, 139 nt, unidentified
  source 1..139: mol_type = other RNA; note = Related to JAGZGD010000017.1; note = Lachnospiraceae bacterium
caacgtgtagttagattttgtacttgtgtttcgcaagtgttggtaaaaatggtagggagatatgcgttctcttacttttttaactatgatgtattgcagagtagtctttaagcatcgcataatgagtaactacacgtta

SEQ ID NO: 15397 - RNA, 133 nt, unidentified
  source 1..133: mol_type = other RNA; note = Related to NZ_AUJA01000011.1; note = Butyrivibrio fibrisolvens
aagcgtgtgattagaattttggcttgtgaatcgcaagttttattattaatgttaggatcgcgtgctatttttatcgcatagttagtacatcttttgttaatatataatctgcataaggagtaatcacacgcat

SEQ ID NO: 15398 - RNA, 130 nt, unidentified
  source 1..130: mol_type = other RNA; note = Related to KE159810.1; note = Lachnospiraceae bacterium 10-1
atgcgtgtggctagatttttggcctgtgtatcgcaggctttgatgaaaatgtcagggacatctgcgccccggtatataatactctgttaacctgtatcttataatcggcaaaaggagtagccacacgcat

SEQ ID NO: 15399 - RNA, 159 nt, unidentified
  source 1..159: mol_type = other RNA; note = Related to JRFX01000003.1; note = Lactococcus lactis
tagcacacaactagactctttgatatgtgtttcgcatatcttgacaacaatggtggaagtttcagcatatacactacatcagtctattcaaagtattcatcggcactgtaagcaaatgtgccacgatgtcgctattcgcataatggtggttgtgtgcgt

SEQ ID NO: 15400 - RNA, 135 nt, unidentified
  source 1..135: mol_type = other RNA; note = Related to NZ_JADPDD010000032.1; note = Lactococcus lactis
tagcatacaactagaccctttgatttgtgtttcgcaaatctgtaaacaaatggtggaaacatcagcatttttatgagtataattgccgttaaggtgtgggcaattgtcgctgcgcatattggtggttgtatgcgt

SEQ ID NO: 15401 - RNA, 143 nt, unidentified
  source 1..143: mol_type = other RNA; note = Related to BJJW01000002.1; note = Leuconostoc citreum
atagtcaaggttggatttttgccctttgaatcgaggggctttacaaaaatggtgggaacattcattgcggtaattttgccaacagggtaacattgctgagctttcacacgttctgtggctgaacaatgagctgccttggcttt

SEQ ID NO: 15402 - RNA, 138 nt, unidentified
  source 1..138: mol_type = other RNA; note = Related to FN822744.1; note = Leuconostoc gelidum
atagtcaaggttggattttcaccctttgaatcgaggggttttacaacaatggtagtaacattcattacgggttcattgccgaagggtaatgttgccgatgttgtttacactttgtgaacaatgagctgccttggcttt

SEQ ID NO: 15403 - RNA, 158 nt, unidentified
  source 1..158: mol_type = other RNA; note = Related to LFQN01000005.1; note = Exiguobacterium acetylicum
atatgtgtggtcagattttttacttgtgtttcgcaagtattgaaaaaaatggtagggagaatagctcgtatatatcccgatttttctcttagttttctcctggttttcccttttatctacgtgtgactcagcggcgcctaaagagtgaccacacataa

SEQ ID NO: 15404 - RNA, 132 nt, unidentified
  source 1..132: mol_type = other RNA; note = Related to DPHU01000079.1; note = Eubacterium sp.
taatgtgtggttagattttgggcctgcgtatcgaaggcattgattaaaatggtgggaacactcgcgatttattatattttttatatctctttatggagacttagttttagcataatgagtaaccacacattt

SEQ ID NO: 15405 - RNA, 134 nt, Streptococcus agalactiae
  source 1..134: mol_type = other RNA; note = Related to LBLH01000065.1
aagcgtatgaacagattttatggcttagcgattcgtaagcctttaactacctagttaggtcctgtagcatagtccatgttggccgtattgatgactttcatgttgccttttgcttaatgagttttcatacgctt

SEQ ID NO: 15406 - RNA, 125 nt, Streptococcus sp.
  source 1..125: mol_type = other RNA; note = Related to NZ_JALDUR010000001.1; note = Streptococcus parasanguinis
atgcgtatgaatagattttatggcttagcggttcgtaagcctttctctcattagtggggggatttagcaagtatctgtatacttgacttgttcgtagcgattgcgtaatgagttttcatacgctt

SEQ ID NO: 15407 - RNA, 132 nt, Streptococcus sp.
  source 1..132: mol_type = other RNA; note = Related to UHFT01000001.1
atgcgtatgaacagattctatggcttagcgtttcgtaagcctttctccctctagcagggagctatagcaagttactttagctgcctagttgacttgtctgttgccttttgcgtaatgagttttcatacgctt

SEQ ID NO: 15408 - RNA, 146 nt, unidentified
  source 1..146: mol_type = other RNA; note = Related to JAGEKB010000001.1; note = Lachnoanaerobaculum sp.
aggcgtatgaaaagattttgtggcttagcgtttcgtaagcctttataataatgttaggaataattatcgtagtccatattatgttttgtttttttggaattctaactgatatacatggttgtaacataatgagttttcatacgcct

SEQ ID NO: 15409 - RNA, 146 nt, unidentified
  source 1..146: mol_type = other RNA; note = Related to JABZPB010000073.1; note = Lachnoanaerobaculum sp.
aagcgtatgaaaagattttttggcttagcgtatcgtaagcctttgtaaccatgttagaggtcatggtcgtattctatataatatattgttttttatgtatcctaaagcatagctaccaatataacataaggagttttcatacgctt

SEQ ID NO: 15410 - RNA, 134 nt, Streptococcus sp.
  source 1..134: mol_type = other RNA; note = Related to VKGS01000001.1; note = Streptococcus cristatus
ctacgtatgacaagatttttgacttagcgcttcgtaagtctttctatcaacggtaggagcgttgctttatactgtctttgtcagtatctgttggcatgtttattgctatacgcgtaatgagttgtcatacgttt

SEQ ID NO: 15411 - RNA, 146 nt, unidentified
  source 1..146: mol_type = other RNA; note = Related to NZ_KV790849.1; note = Granulicatella sp.
atgcgtatgaaaagattttatggcttagcgtttcgtaagccttcaaaacattagtgggagatgctagcgcaagtactacttcatccaccttatgaacagctaatttgctgtcactgttgctttgcataatgagttttcatacgctt

SEQ ID NO: 15412 - RNA, 134 nt, Staphylococcus aureus
  source 1..134: mol_type = other RNA; note = Related to NZ_UHCA01000002.1
tgtcgtgtggttagattttttgcacgagtttctcgtgtgttgacaaaaatgttgataacattagttttgtttcataattttccgataatcttttgcgtttatagtttttgaacataatgagtaaccacacgatg

SEQ ID NO: 15413 - RNA, 127 nt, unidentified
  source 1..127: mol_type = other RNA; note = Related to JAIMFU010000001.1; note = Salinicoccus roseus
aatcgtgtggttagagatttcacatgatgtttctcatgtgttgattgtaatggtagagaaattactcgccgtttaaacactcgtatactgctcgtatataaaatgcacaatgagtaaccacacgatt

SEQ ID NO: 15414 - RNA, 133 nt, Staphylococcus sp.
  source 1..133: mol_type = other RNA; note = Related to NZ_VELK01000002.1; note = Staphylococcus hominis
aaatgcatggctagattttttacttgtgtttcgcaagtatttataaaattgttggcggatttgcatattgtcaactatttacattttcttaatttgtgttgtacttaatagcctaatgagtagccatgcataa

SEQ ID NO: 15415 - RNA, 131 nt, Staphylococcus sp.
  source 1..131: mol_type = other RNA; note = Related to NZ_CP023497.1; note = Staphylococcus simulans
tagcgcatggctagaatttttgcttgtgtttcgcaagcatttatcgaattgctggcgatatttgcttttagtcagctttacattttcgttctacatttccactaaacagcctaatgagtagccatgcgtat

SEQ ID NO: 15416 - RNA, 131 nt, unidentified
  source 1..131: mol_type = other RNA; note = Related to JALGOX010000003.1; note = Mammaliicoccus sciuri
aagcgcatggctagaatttttacttgtgtttcgcaagtgtttataggattgttagtaggtttgcatatatgtaaattttctcgttagaattttgcttcgacgtttacagccaaatgagtagccatgcgtat

SEQ ID NO: 15417 - RNA, 128 nt, Staphylococcus sp.
  source 1..128: mol_type = other RNA; note = Related to CP068216.1; note = Staphylococcus pasteuri
atgcgtatggctagaatgtttacttgtgtttcgcaagtatttatatgaaagtccatggattttcattgttttaattttcttttctatttttgcacttaatttctagactaatgagtagccatacgtat

SEQ ID NO: 15418 - RNA, 132 nt, Staphylococcus sp.
  source 1..132: mol_type = other RNA; note = Related to PZEX01000047.1; note = Staphylococcus warneri
ttatgcatggctagaaattttgcttgtgtttcgcaagcatttatataattgttagggagatttgcatattgctaacttttcatttattttcagaattttatattcaattgccaaatgagtagccatgcattc

SEQ ID NO: 15419 - RNA, 131 nt, unidentified
  source 1..131: mol_type = other RNA; note = Related to NZ_MJBI02000011.1; note = Macrococcus goetzii
atgcgtatggctagaatttttacttgtgcttcgcaagtgtttataaaattgtatgtgagatagcttcttatcaattgtccattcgattatgaattatccttttataatgcctaatgagtagccatacgcat

SEQ ID NO: 15420 - RNA, 179 nt, unidentified
  source 1..179: mol_type = other RNA; note = Related to NZ_JQBL01000009.1; note = Kandleria vitulina
atgcgcatgattagatcttttgactcatgaatcgtgagtcttggcggaaagggtactcgacgactgtttaaataatttttaatattatgctttatagcacgccctttcagaatatatttataagcactttttagaatattcacgtgttttgttgttttataatgagttatcatgcgctt

SEQ ID NO: 15421 - RNA, 142 nt, Acinetobacter sp.
  source 1..142: mol_type = other RNA; note = Related to CP077398.1; note = Acinetobacter nosocomialis
tgtcctttgggaagatttttagattgcgtatcgcattctgttttgaaaatgtcagtggcttattgtcaaatttgccaaccaattattgggcaccctgctaaccatgctgttgtgcgttgaccatatgagttcccaaggggca

SEQ ID NO: 15422 - RNA, 142 nt, Acinetobacter sp.
  source 1..142: mol_type = other RNA; note = Related to CP059039.1; note = Acinetobacter baumannii
tgccctttgggaagatttttagattgcgtatcgcattctgttttgaaaatgttaatggcttattgtcaaattagccaaccagtcattgggcactctgctaaccatgctgctgtgcgttgaccatatgagttcccaaggggca

SEQ ID NO: 15423 - RNA, 141 nt, Acinetobacter sp.
  source 1..141: mol_type = other RNA; note = Related to KB850198.1; note = Acinetobacter colistiniresistens
tgccccttgggaagatttttagattgcgtatcgcaatctgttttgaaaatgttaatggcttattgtcaaatttgccggtatgtattggttacgccgctaagtatactcttgtgcgatgaccatatgagttcccaaggggta

SEQ ID NO: 15424 - RNA, 141 nt, Acinetobacter sp.
  source 1..141: mol_type = other RNA; note = Related to JAKZGD010000010.1
cgctccttgggaagatttttagattgcgtatcgcaatctgttttgaaaatgttaatggcttattgtcaaatttgccgatatgtattggttacgccgctaagtatactcttgtgcgatgaccatatgagttcccaaggggta

SEQ ID NO: 15425 - RNA, 142 nt, Acinetobacter sp.
  source 1..142: mol_type = other RNA; note = Related to NZ_CP039031.1; note = Acinetobacter indicus
tgccctttgggaagatttttagattgcgtatcgcagtctgttttgaaaatgtgaacggcttatgtctgaactcttgccgacgctacacttgtgctgtgcggttttttccccgtactgtgaccatatgagttcccaaggggca

SEQ ID NO: 15426 - RNA, 144 nt, Acinetobacter sp.
  source 1..144: mol_type = other RNA; note = Related to NZ_CP054822.1; note = Acinetobacter lwoffii
cgccctttgggaagatttttagattgcgtatcgcagtctgttttgaaaatgtgagaggcgtattgtccaatgcttgccgatactatactttgtgctgaacagttggctctgctgtactgtgaccatatgagttcccaaggggca

SEQ ID NO: 15427 - RNA, 143 nt, Acinetobacter sp.
  source 1..143: mol_type = other RNA; note = Related to NEGA01000008.1
agccctttgggaagatttttagattgcgtatcgcagtctgttttgaaaatgtgaaaggcgtattgtcaaatttgccaatgttatgttgtgtgctgttactggtagtgccgctgtgctgtgaccatatgagttcccaaggggca

SEQ ID NO: 15428 - RNA, 141 nt, Acinetobacter sp.
  source 1..141: mol_type = other RNA; note = Related to SGSS01000016.1
tacctcttgggaagatttttagattgcgtatcgcagtctgttttgaaaatgttaatggcttattgtcaaatttgccaaccagttttgggcactctgctaaccatgctgatgtgcgttgaccatatgagttcccaaggggta

SEQ ID NO: 15429 - RNA, 136 nt, Acinetobacter sp.
  source 1..136: mol_type = other RNA; note = Related to JAGJSX010000002.1; note = Acinetobacter nosocomialis
atatcggtgattagaaattgagttgtgtatcacaacttgctgactaatgttagcagaactgcttaactacgtacgaccttttaatggttgaactttgataaataactggtgtcgccatttgagttttcaccgatat

SEQ ID NO: 15430 - RNA, 132 nt, Acinetobacter sp.
  source 1..132: mol_type = other RNA; note = Related to NZ_VOZD01000001.1
atatcggtgattagaaattgagttgtgtatcacaacttgctgactaatgttagcagaactgcttaactacgtacgaccttaatggttgaactttgataaaactggtgtcgccatttgagttttcaccgatat

SEQ ID NO: 15431 - RNA, 177 nt, Acinetobacter sp.
  source 1..177: mol_type = other RNA; note = Related to NZ_FMYO01000016.1; note = Acinetobacter kookii
ctatctgtgaatagattcatggattgtgtttcgcaatctgatttctaagggtcaggacatgagctaacttatgtcttcctgaaatttctttcgtataagaaggattttaataattccttgaggctttctctcttttgagaatgcttgatggttcgccataagagttttcacagatag

SEQ ID NO: 15432 - RNA, 181 nt, Acinetobacter sp.
  source 1..181: mol_type = other RNA; note = Related to NZ_CP032279.1
ctatctgtgaatagattcatggattgtgtttcgcaatctgatttctaagggtcaggtaatgagctaaaatttattatcttcttagattttttcttaatagaaattttttatacttatttgaggctttcttcttttcttggagattgcttaggttatacgccataagagttttcacagatag

SEQ ID NO: 15433 - RNA, 143 nt, unidentified
  source 1..143: mol_type = other RNA; note = Related to NZ_CAJHAW010000011.1; note = Psychrobacter salsus
tcccttctgggaagattattgggatgcgtatcgcaacctgttctgaaaatgtaagagtttctgtctgattcctgtaaggattctgatagttctaatggtgtctatagtatctgtactgtgaccacatgagttcccagaaggaa

SEQ ID NO: 15434 - RNA, 144 nt, unidentified
  source 1..144: mol_type = other RNA; note = Related to NZ_CAJGZW010000014.1; note = Psychrobacter immobilis
tgccctctgggaagattattagattgcgtatcgcaatctgttttgagaatgtaaggtcttatgtctgattacgcctacggtaatctgatactgctataggtatctaaaatattgtacggtgaccatatgagttcccagagggtt

SEQ ID NO: 15435 - RNA, 139 nt, Acinetobacter sp.
  source 1..139: mol_type = other RNA; note = Related to AAYLMD010000006.1; note = Acinetobacter baumannii
tgtcctttgagaagatatttggatagcgaatcgctatctattttattaagattggaatccaatctgtcgaaatctcttgaagtgagctataatttcttaaagttatgctctgataagaccagtgagttctcaaaggaca

SEQ ID NO: 15436 - RNA, 140 nt, Acinetobacter sp.
  source 1..140: mol_type = other RNA; note = Related to JEWN01000001.1; note = Acinetobacter baumannii
tgtcctttggaaagatctttaaatagcgtatcgctatttgttttgaaattgggcttaggctcttcttttgtccagcaatactttgcggtcagtgcttagtcactctgcacggttgttgaccattgagtttccaaaggaca

SEQ ID NO: 15437 - RNA, 123 nt, Acinetobacter sp.
  source 1..123: mol_type = other RNA; note = Related to NZ_VTRF01000001.1; note = Acinetobacter baumannii
gcacctatggaaagatttatgattgtgattcgcaattatgtatctaatgttaaggcactatgacaagttaccttaagataacctttaaaacgtactagaagtccatgaagtttccataggtgc

SEQ ID NO: 15438 - RNA, 124 nt, Acinetobacter sp.
  source 1..124: mol_type = other RNA; note = Related to NZ_BKVP01000163.1; note = Acinetobacter ursingii
gcacctatggaaagatttatgattgtgattcgcaatcatgtatctgatgttaagacacaatagttgtaacgttagagtataacctataagacgtactagaagtccatgaagtttccataggtgt

SEQ ID NO: 15439 - RNA, 124 nt, Acinetobacter sp.
  source 1..124: mol_type = other RNA; note = Related to JADVON010000009.1; note = Acinetobacter bereziniae
gcacctatggaaagatttatgattgtgattcgcaattatgtatctaatgttaaggcacaatgtagagtaaccttggcataacctttaaaacgtactggtaagtccatgaagtttccataggtgc

SEQ ID NO: 15440 - RNA, 124 nt, Acinetobacter sp.
  source 1..124: mol_type = other RNA; note = Related to SJOH01000014.1
gcacctatggaaagatttatgattgtgattcgcaatcatgtatctaatgttaagacacaatgtaatgtaaacttagtataacctttagaacgtactaggtagtccatgaagtttccataggtgc

SEQ ID NO: 15441 - RNA, 122 nt, Acinetobacter sp.
  source 1..122: mol_type = other RNA; note = Related to SJOG01000001.1
gcacctatggaaagatttatgattgtgattcgcaatcatgtatttaatgttaaggcactttgacgatagccctaatataatcggtgaaacgtactggtagtccataaagtttccataggtgc

SEQ ID NO: 15442 - RNA, 153 nt, unidentified
  source 1..153: mol_type = other RNA; note = Related to NZ_LN776178.1; note = Necropsobacter sp.
gtgggtataagcagattttttgctttgtttcggagcaagtattgataatattggcgtaattgttaataattattgtaccatctaataaatttagattttaaactattttaatagcttagctagctaacatcacataagagtgcttgtacccac

SEQ ID NO: 15443 - RNA, 159 nt, Pasteurella sp.
  source 1..159: mol_type = other RNA; note = Related to PPWW01000004.1; note = Pasteurella multocida
gtgaatataagcagaacattttactttgtttcggagtaagaattaatcatgtagcaatcagttttattgcttacattatctattaacttaatgtagttattacaaataaaacattaagtagcatcctcagaggaatcgcataagagtgcttatattcac

SEQ ID NO: 15444 - RNA, 151 nt, unidentified
  source 1..151: mol_type = other RNA; note = Related to NZ_CP031477.1; note = Haemophilus parainfluenzae
gtggatataagcagattttttgctttgtttcggagcaagtattaataatattggtgttgctaccactgttatctcatattttaaccactaagaaatgtagtagatttatatctagatagcatggctataacgtaagagtgcttatattcac

SEQ ID NO: 15445 - RNA, 136 nt, unidentified
  source 1..136: mol_type = other RNA; note = Related to NZ_CP072548.1; note = Aggregatibacter sp.
gtgggtgtgaatagaatttttgctttgtttcgaagtaactattaacaaagtccggtggattttgtatatttaactgcataattatcatgatattagtagcttaatatataagtcactaatgagttttcacacccac

SEQ ID NO: 15446 - RNA, 131 nt, unidentified
  source 1..131: mol_type = other RNA; note = Related to MLHL01000009.1; note = Rodentibacter trehalosifermentans
gtgggtatagatagatttttcacttttgtttctgaagtggttacataaaatgtcaagagttgatgtatataattatcgtagtattttaatacttcgattacttagcattactaatgagtatctatacccac

SEQ ID NO: 15447 - RNA, 130 nt, unidentified
  source 1..130: mol_type = other RNA; note = Related to VSFH01000001.1; note = Lonepinella koalarum
gtaggtataaatagatttttcacttttgtttctgaagtggtttcaaaaaatatcaagacttgatgtgatgattatcttagtagataaaatactaagaggatttagcatactaatgagtatttatacctac

SEQ ID NO: 15448 - RNA, 130 nt, unidentified
  source 1..130: mol_type = other RNA; note = Related to NZ_JTLX01000008.1; note = Haemophilus haemolyticus
gcaggtataaatagatttttcacttttgtttcaggagtggttttaaataatgtcaggaattgatgctgataatattgtaagtactaagaagtttagtagattaaacttgccaatgagtatttatacctgc

SEQ ID NO: 15449 - RNA, 138 nt, unidentified
  source 1..138: mol_type = other RNA; note = Related to JQHF01000020.1; note = Neisseria mucosa
gcggctacaaacagatgttttgcccttgtttcggggtgactataaacaatgtcagggcttcatgtatccctgttccatactcgattctattgtttatgagcagtagtattgtttttaccaaagagtgtttgtagccgt

SEQ ID NO: 15450 - RNA, 138 nt, unidentified
  source 1..138: mol_type = other RNA; note = Related to CP091516.1; note = Kingella potus
tgaggcataaatagatttgttatcctgattcgggataatttaaaacaatgtaccaagggtaacgcgcctcgtgcagtctgcacttgtcgctaattactccatattttgtttgacttcagtgagagtatttatgcctct

SEQ ID NO: 15451 - RNA, 149 nt, unidentified
  source 1..149: mol_type = other RNA; note = Related to NZ_CP042408.1; note = Lactococcus lactis
taggataataatagattatatgtggggtatccccataagttataaaaatgtttgaagggtttcggctcaaatatctgctattaggcgtataagtaattggcaatcatagcttatacggcattcgctacgctcaggagtattctatccat

SEQ ID NO: 15452 - RNA, 127 nt, unidentified
  source 1..127: mol_type = other RNA; note = Related to NZ_CM001979.1; note = Dickeya sp.
agggctataggcagattttttatcacgaagcgtgatatgtgaaaagaatgtccggcggaatgccatcaatgttttaagatcaccgataacagtttgccggtgagcttaatgagtgcctatagcacct

SEQ ID NO: 15453 - RNA, 126 nt, unidentified
  source 1..126: mol_type = other RNA; note = Related to CP011427.1; note = Pantoea vagans
agggctataggcagatcttttatcacgaagcgtgatatgtgaaaaaaatgtccggcggaatgctatcaatgtgttcaggttgccgataatgggcggccgttgtgcttaatgagtgcctatagttcc

SEQ ID NO: 15454 - RNA, 128 nt, Salmonella sp.
  source 1..128: mol_type = other RNA; note = Related to ABDODY010000002.1; note = Salmonella enterica
agggctataggcagattttttgtcacgaagcgtgatatatgaaaaaaatgtccggtggaatgccgatcaaagtgttaagtaatctgatgaccagattgcaaatgagcttaatgagtgcctatagttcc

SEQ ID NO: 15455 - RNA, 128 nt, Enterobacter sp.
  source 1..128: mol_type = other RNA; note = Related to JAJKGJ010000001.1; note = Enterobacter hormaechei
agggctataggcagattttttgtcacgaagcgtgatatatgaaaagaacgtccggtggattgccgatcaaagtgttaagttacttgatgattagattgcaaatgagcttaatgagtgcctatagaccc

SEQ ID NO: 15456 - RNA, 124 nt, unidentified
  source 1..124: mol_type = other RNA; note = Related to NZ_CTIT01000003.1; note = Yersinia enterocolitica
gggtctataggtagattttttatcgcgaagcgcgatatgtgaaaacaacgttgggtagattgccactgtaaagtgatgcaccagtagtaatggtctgcatagcataatgagtgcctataggccc

SEQ ID NO: 15457 - RNA, 141 nt, unidentified
  source 1..141: mol_type = other RNA; note = Related to SAXY01000032.1; note = Brachyspira pilosicoli
aagcttacagatagatatttcatgttgcatttcgcatgagaagatttattatagcaagagtttttcagtatatagctatatatctgtttatttttttgcaccaagcttggtgcggttttacttaagagtatctgtaagctt

SEQ ID NO: 15458 - RNA, 140 nt, unidentified
  source 1..140: mol_type = other RNA; note = Related to NZ_SAXU01000001.1; note = Brachyspira aalborgi
tagcttacagatagatttttcctgttgatttcgcaggagatgatttattatagggttagtgtttaagtaaaaatgctgctttttctttattccatatactgtgcacagtatatgtcttacataagagtatctgtaagctt

SEQ ID NO: 15459 - RNA, 139 nt, unidentified
  source 1..139: mol_type = other RNA; note = Related to NZ_CP019600.1; note = Brachyspira hyodysenteriae
tggcttgcagatagatttttcaggcgaatcgcttgaggagatttattgtatcgtcaggttttaggacattaaacttcattttttgtcgttggtacatatatatatgtactacacttgtcccgtgagtatctgcaagtca

SEQ ID NO: 15460 - RNA, 136 nt, unidentified
  source 1..136: mol_type = other RNA; note = Related to SAXX01000003.1; note = Brachyspira aalborgi
aagcttgcagatagatttttcttgtcgtttcgcaagaggagattttttgtatcatcactttttaggactgtctgtttgtatatgtatatacagaaagaccttgaaaatttatcgtcccgagagtatctgcaagcca

SEQ ID NO: 15461 - RNA, 161 nt, Bacillus sp.
  source 1..161: mol_type = other RNA; note = Related to LITP01000001.1
ttaggcaagcaaggaacagttgaacttttgatggtggtaatcgctatcttataattaaatgtatctacagatcttcacgctctattctagttgtttatcgaattgtcatatggtatcaacggtatgatttagaaaggtagaactgtacttgtttgcctact

SEQ ID NO: 15462 - RNA, 154 nt, unidentified
  source 1..154: mol_type = other RNA; note = Related to JABMKX010000008.1; note = Paenibacillus tritici
acaagttgtatttgaacttttgatggtgataatcgctatcttatattttaatgtatctacacatctctctgcactattctcattgttggatccaattgtctcacatggtatctacgcggtgatttagaaaggtagaaatgcagcattacttttg

SEQ ID NO: 15463 - RNA, 162 nt, unidentified
  source 1..162: mol_type = other RNA; note = Related to NZ_FCOQ01000017.1; note = Paenibacillus sp.
ataggcaggcaagttgcagttgaacttctggtagtgctaatcgctatcttataaaaagaatgtaactacatatcctacgcgcaattttcagtatttatctaaatgtcgcaatggtttcaacggtatgatttagaaaggtagaactgcacttgtttgcctact

SEQ ID NO: 15464 - RNA, 163 nt, unidentified
  source 1..163: mol_type = other RNA; note = Related to NZ_JAKGAO010000024.1; note = Paenibacillus tarimensis
ttaggcaagcaagatgcagttgacttttggatggtgataatcgctatccaacaacctaaggtaactacgtatcgctatgtactactcgcgctgtttatcgaattgtctcacttggtatcaccggagtaatttagaaaggtagaactgcacttgtttgcctact

SEQ ID NO: 15465 - RNA, 164 nt, Bacillus sp.
  source 1..164: mol_type = other RNA; note = Related to NZ_CP033906.1
tttggcaagcatgaggtaattttaattttaggttgtgaaatcgcaacccgaatatttaatgtattatttatctgcgtcacttttacgtattttctacttttagctaatcgcgtataattttctatttaatttagaaaggtagaatttatccatgcttgcctaag

SEQ ID NO: 15466 - RNA, 156 nt, Bacillus sp.
  source 1..156: mol_type = other RNA; note = Related to NZ_CP082279.1; note = Bacillus amyloliquefaciens
acagcaagggtaagaaaaaattgactttatggcggtgaaatcgccgtctgttatttaaagggtatacttaatttacacgcttattttatcttcgaagttttattcgatttgtctaatcgctattaggagaagggtagaattttaacccttgctgtt

SEQ ID NO: 15467 - RNA, 159 nt, Bacillus sp.
  source 1..159: mol_type = other RNA; note = Related to CP018574.1; note = Bacillus altitudinis
tagcagcaagggtgagaaatttattttatggcggtgaaatcgccgtctgttattttaaagtatatactaaatatgcacgcttattttatcttataaggttttatacgatttttctaaacgctattaggagaagggtagaattttaacccttgctgttgt

SEQ ID NO: 15468 - RNA, 146 nt, unidentified
  source 1..146: mol_type = other RNA; note = Related to PDYK01000012.1; note = Sporosarcina sp.
tggggaagtagggaacaatttacattcgcggtgataatcgctgcgtcttatataaatgtatgatttactcacgtgtatcttatattgttttccgcgtcgtctatgtcggggtaactagaacggtagaattatccctactcccctct

SEQ ID NO: 15469 - RNA, 136 nt, unidentified
  source 1..136: mol_type = other RNA; note = Related to NZ_CP047363.1; note = Macrococcus canis
tgagggaagttgaatttaaagttgtgtaactgcgacttatgctttcaatgtttctatagcgttatcgctatatatatactatgtttattttccatttagaaaatattgtaatcgaaaacggtagaacttccctctt

SEQ ID NO: 15470 - RNA, 155 nt, unidentified
  source 1..155: mol_type = other RNA; note = Related to NZ_RHHV01000019.1; note = Brevibacillus parabrevis
attggggtaggggtattaattgatttccactgttgtaattgcggtggtctataggaatgtcagtagcacattccgttgtactagttaactttatcgcgtaaattgttttatctgtatcgcgctaattaataaggtagaattaaccctcccctttc

SEQ ID NO: 15471 - RNA, 156 nt, unidentified
  source 1..156: mol_type = other RNA; note = Related to NZ_VDZO01000006.1; note = Paenibacillus xylanexedens
atacggggaagggaagtaattgatttccactgttgttactgcggtggtttatagcaatgttaggcacacattttccgatgtctcgctatttttatttgtctcgttaaattttccctactagtaatttaatgaagtagaattccccttcccctcttc

SEQ ID NO: 15472 - RNA, 155 nt, unidentified
  source 1..155: mol_type = other RNA; note = Related to NZ_BOSB01000004.1; note = Paenibacillus lautus
aagaatcggtaggagaggtaattgactaccactgtcgtaaatgcggtggcgaattaaacaaaggttaatacgcattcgttgtctaatttggtctcgttttccttatcggctgttatcgaatagtaataaggtagaattcatcctgccggttctct

SEQ ID NO: 15473 - RNA, 168 nt, Bacillus sp.
  source 1..168: mol_type = other RNA; note = Related to LYUE01000007.1; note = Bacillus siamensis
cagagacggtttggtcatattgatttccactgttgtaattgcggtggtgtattaaaatgtaagggcaaattttcccacgttgtctcttacgctatttactgtactattcgacttttacgattatattatcatgtttttaataaggtagaatacgccaaccgtctctta

SEQ ID NO: 15474 - RNA, 163 nt, unidentified
  source 1..163: mol_type = other RNA; note = Related to NZ_VDST01000009.1; note = Priestia megaterium
agagactgatgagaggtaaaattgatttccactgtttgtaattgcggtggtgtataaaaaggtaagagcagatcttatgcgcctttttcgctattatactttttcgactattttgttaacttgtcgctatgtatcataaggtagaatttcctcacagtctctt

SEQ ID NO: 15475 - RNA, 152 nt, unidentified
  source 1..152: mol_type = other RNA; note = Related to NZ_AUCI01000050.1; note = Salibacterium aidingense
gaaggaaagtgagcggaagattgatctcgctgttgttactgcagtgttatattaaaatgttagtggatactccgcttatccgctacgttattcacattactttaatcgttaatcgcatcaaataataaggtagaatctctcacttccttcct

SEQ ID NO: 15476 - RNA, 235 nt, unidentified
  source 1..235: mol_type = other RNA; note = Related to NZ_KB907919.1; note = Kushneria aurantia
gctgagggttccaacgtgactttctagtgatgctggtgccgcaaggcgccggttcgggtggcggtatcgtcatcatgacggggcgcagactactgctgcttcgcgttggagctgacgcatgaggacaggcgcctcctgcagtgaccctccggggctgctcgaggtctcgccttcactgcaggaggtgactgacccttcgggtctcaaaggtagatggaacgttggaatcctcaca

SEQ ID NO: 15477 - RNA, 235 nt, Pseudomonas sp.
  source 1..235: mol_type = other RNA; note = Related to DAFSJF010000019.1; note = Pseudomonas aeruginosa
gctgagggttccagcatgactttctagtgatgccggtgccgaaaggcgtcggttcggatgacgatttcgtcatcatgacggggcgcagactactgccgcttcgcgttggagcttaggcatgagggcaggcgcctcccgcagcgacccttcggggcggttcgaggtctcaccttcgctgcgggaggtgactgacccttcgggtctcaaaggtagatggaacactggaaccctcaac

SEQ ID NO: 15478 - RNA, 237 nt, Citrobacter sp.
  source 1..237: mol_type = other RNA; note = Related to NZ_RHWV01000005.1; note = Citrobacter farmeri
tctgagagtttcagtatgactttctagtgatgctggtactgagaaggtaccagttcggatgactatttagtcatcatgacggggcgcagattactgttgcttcgcgttagagcttacgcatgagggacagacgcctccagcaacgaccctccggggcggctcgaggtctcgccttcgttgccggaggtgactgacccttcgggtctcaaaggtagatggaacgctggaactctcaaa

SEQ ID NO: 15479 - RNA, 237 nt, unidentified
  source 1..237: mol_type = other RNA; note = Related to NZ_CADEYZ010000005.1; note = Burkholderia gladioli
attgagggtgccagcgtgaccgtttagtgatgccggcgtcgcaggacgttggtcggatgatgacttaggtcgtcgaagagggggcacagattactgtcgcttcgcgcatgagctcccgctagaggcaaatcgcgctccgccgtgaccctaacggggcggctcggtgcctcgccttctcggcggagcgtgacttacccttcgggtatcaaaggtagatgcaacgctggaaccctcaac

SEQ ID NO: 15480 - RNA, 235 nt, Pseudomonas sp.
  source 1..235: mol_type = other RNA; note = Related to JABEMH010000060.1; note = Pseudomonas fragi
gttgagggtcccagcatgactttctagtgatctcagcgtcgaaaggcgctgattcggatgacgacattgtcgtcacgacggggcgcagactactgtggcttcgcgttagagcttccgcatgaggttagccgtctcccgcagtgaccctgcggggcggctcgaggtctcgccttcactgcgggagatgacttacccttcgggtatcaaaggtagatggaacgctggaaccctcaac

SEQ ID NO: 15481 - RNA, 237 nt, unidentified
  source 1..237: mol_type = other RNA; note = Related to SEFB01000022.1; note = Rubrivivax sp.
gttgagggcgccagtttgacttctagttgttgtcagggccgaaaggtgctgacgccgatggcgacttttgtcgtctcgtcggggcgcagatttctgttgcttcgcgttgtagctcccgcttgaggtcaagcctcctcccgcagcgaccctgcggggcggatcgaggcctcaccttcgctgcgggaggtgacttacccttcgggtatcaaaggtagatggaacgctggagccctcgcc

SEQ ID NO: 15482 - RNA, 237 nt, unidentified
  source 1..237: mol_type = other RNA; note = Related to JAHNIZ010000026.1; note = Paraburkholderia fungorum
gctgagagctccaccgtcttcttctagatgatgctagtgcttgggtgctagcgccgatgacgtccgttgacgtcacaaggggcgcagattactgctgcttcacgttgaagctcctgctcgaaggctaagccgcctcccgcgtcgccccctccggggacggtgcgaggacttaccttcgatgcgggaggtgactcaccctagggtgccaaaagtagatggaacgctggagttctcacc

SEQ ID NO: 15483 - RNA, 198 nt, unidentified
  source 1..198: mol_type = other RNA; note = Related to CP000050.1; note = Xanthomonas campestris
gttgagggcgccagtttagatctctagcgttaaggcagttcccgagcgcagcttactgcgtctctctgaaacagctcccgcttgctgctgacgcatcacgcctcctgccgcttcgcgggcgtgtcggggtctcacctcaggatgcgtgatacctcaccaagagcaggtcaaagtagatgtcagactggcgtcctcaac

SEQ ID NO: 15484 - RNA, 202 nt, unidentified
  source 1..202: mol_type = other RNA; note = Related to JAIOAG010000002.1; note = Stenotrophomonas maltophilia
gttgagggcgccagtctagacttctagcgttgacggaagtcggagcgcagcttactgcgtctctctggaagagcacccgcttgtcgctgatgcatcgcgcctcctgccgcccaagggcgggcggctcggggtctcacctcaggatgcgcgacacttcacctagaaagcaggtcaaagtagatgtcggactggcgccctcaac

SEQ ID NO: 15485 - RNA, 201 nt, unidentified
  source 1..201: mol_type = other RNA; note = Related to NZ_RWJW01000004.1; note = Xanthomonas axonopodis
gttgagggtgccagtctaagcatctagcgttgacagatcgtcggagcgcagattactgcgtctctttggaagtgcacccgcttgccgatgacgcgtcacgcctcccgccgcgcaagcgcggccgtgtcggggtctcccctcgggatgcgtgacacctcaccaaaagcaggtcaaagtagatgtcggactggcactctcaac

SEQ ID NO: 15486 - RNA, 237 nt, unidentified
  source 1..237: mol_type = other RNA; note = Related to MTCS02000083.1; note = Haliangium sp.
gttgagggcgccagaggagacttctagttgatgccggcaaatgccggcgccgacatgtggccgtgcgctgcatgtaatcgggacgcagagtctgcgatccttcggcatagctcgcgcttgatgctaaggcgtgtcgcgcactgccgcctgcggcggatcgcggcgaggtcttgcttcagcgcgcgacacgtctcacccatggggtgtcaaagtagatgactcgctggcgccctcaac

SEQ ID NO: 15487 - RNA, 236 nt, unidentified
  source 1..236: mol_type = other RNA; note = Related to JAAXRA010000003.1; note = Rhizobium laguerreae
gttgagggcgccagtgagtctttctagatgacgccggttcgccggcggcgacatctggctaatggccaggtgtctcggggcgcagattctgcagctcttaggctaagcgtccgctcgaagctaaggcacatcacgcaacgccgccttgcggcggatcgcgtcgaggtcttgctacgtcgcgtgatgtgtctcacccccagggtgtcaaagtagaatgacaacctggcgccctcaac

SEQ ID NO: 15488 - RNA, 239 nt, unidentified
  source 1..239: mol_type = other RNA; note = Related to NZ_NWSJ01000022.1; note = Rhizobium anhuiense
gttgagggcgccagtgagtctttctagatgacgccggtgtaccggcggcggcatctggtcactggccaggtgtctcggggcgcagattctgcagctctcaggctaagcgtccgctcgaagctaaggcacatcgcgcaacgccgccgcgtggcggcggtcagtgtcgaggtctcgcttcgtcgcgcgatgtgtctcacccccagggtgtcaaagtagaatgaccagttggcgccctcaac

SEQ ID NO: 15489 - RNA, 252 nt, unidentified
  source 1..252: mol_type = other RNA; note = Related to NZ_BCYZ01000072.1; note = Sphingomonas pruni
gttgagggctcctgtgggatcgcatagttgacgtcgccgcatcagctttgctgttgtttcgacggcagcatatggtcttcgggccatgtgcttcggggcgcagaatctgctgctctcaggacaagccttcgctcgatgctaaggcacatcgcgcaacgccgcctgcggcggatcgcgtcggtgtctagctacgtcgcgcgatgtgtctcacccccagggtgtcaaagtacgtgacctcctggagccctcaac

SEQ ID NO: 15490 - RNA, 241 nt, unidentified
  source 1..241: mol_type = other RNA; note = Related to NZ_CP021467.1; note = Komagataeibacter europaeus
gttgagggcgccgcagggactttctagttgatgccggtcgagaggccggcgccgggccgaaagccttcgggcttgacgtccatgggccgcagactctgcgtgtctacggaaaagcgggcgcttgaagctaaggcagatcgcgaagtgccgccttcggcggttcgcggtgatgtcttgctccactccgcgatctgtctcaccccttgggtgtcaaagtagatggtcgggtggcgccctcaac

SEQ ID NO: 15491 - RNA, 238 nt, unidentified
  source 1..238: mol_type = other RNA; note = Related to SADI02000018.1; note = Mesorhizobium sp.
gttgagggctccctcgaaggtgtctagttgatgccggttaccccggcaccgatgggtggtcttcgggccgctcattcacggagcgcagattctgcgtctctttggccaagcgtccgctcgatgctaaggcatgtcccacagcgcccgctcaagggcgggccggggcgatgtcttgctcgctgcgggacatgtctcacccccagggtgtcgaagtagatgtcccggtggagccctcaac

SEQ ID NO: 15492 - RNA, 238 nt, unidentified
  source 1..238: mol_type = other RNA; note = Related to RZQP01000036.1; note = Mesorhizobium sp.
gttgagggctccatcgaaggtgtctagttgatgccggtcattccggcaccgatgggcaatcttcggattgttcattcacggactgcagattctgcagctctttggccaagcgtccgcttgatgctaaggcatgtcccacagcgcccgcccaagggcggttcggggcgatgtcttgctcactgcgggacatgtctcaccccttgggtgtcgaagtagatgtcccggtggagccctcagc

SEQ ID NO: 15493 - RNA, 238 nt, unidentified
  source 1..238: mol_type = other RNA; note = Related to LMHK01000002.1; note = Devosia sp.
gttgagggttccattcggacgttctagttgatgccggccccccgccggcacctgcatccagccgccgtgctgtttgctcggggcgcagattctgcagctctttggtctagctcgcgcttgaggccaaggcatctcccacatcgtccgcctgacggcggcgcagggcgtagccttcctcgatgcgggagatgtctcaccttttcggtgtctaagtagatgactcggtggaaccctcagc

SEQ ID NO: 15494 - RNA, 227 nt, unidentified
  source 1..227: mol_type = other RNA; note = Related to JAAOYS010000006.1; note = Dyella sp.
gctgagggggccagttccttctgtttagttcagccacttcggtggcgccagcgcatgtcttccatgctggtggggcgcagactctgttgcctcctgtaatagctctcgcatgatgctcaggcaggtcacgcaatggtcgcgagcgaccggagcgaaagccttcctccatcgcgtgacctgtctcaccctacgggtgtcaaagtagatggaagactggctccctcagc

SEQ ID NO: 15495 - RNA, 231 nt, Bacillus sp.
  source 1..231: mol_type = other RNA; note = Related to NADW01000002.1
gttgagggagccagtcccttccgtttagttcacgtcgcctcgggcggcgccattgcatgggattccatgttttgggggcgcagattctgctgccttctgtaatagctgtcgcatgatgctcaggcaggtcacgcaatgcccgcgtagcggacagagcgaaagcctcccttcatcgcgcgacctgtctcaccctacgggtgtcaaagtaaatggaaaactggctctctcagc

SEQ ID NO: 15496 - RNA, 232 nt, unidentified
  source 1..232: mol_type = other RNA; note = Related to QQSY01000005.1; note = Dyella solisilvae
gctgagggcgccagtggggaattctagttagccgggcctagcccggtgccggcttacagttaaccgtaagtaagcggggtgcagagtctgcttcccttcgtattagctctcgcttgatgctaaggcaggtcacacgattgccgctgcgcggcacgtgcggatgtcttactgcatcgtgcgacctgtctcaccctacgggtgtcaaagtagatgacccactggagccctcagc

SEQ ID NO: 15497 - RNA, 225 nt, unidentified
  source 1..225: mol_type = other RNA; note = Rhodospirillales bacterium; note = Related to JACRPC010000021.1
gctgagggcgccacgccgtgtgtctagttgacgctggcactggccagcggcgacaggcggttttcagacccctgtccacggggagcagattctgcgtcctttcggaaaagcgtcggcttgcggctaaggccggtcacgccttatctcgcggcgaagtctggcggcaaggcgcgaccggtctcacccttcgggtgtcgaagtagatgacgatgtggcgtcctcagt

SEQ ID NO: 15498 - RNA, 230 nt, Pseudomonas sp.
  source 1..230: mol_type = other RNA; note = Related to CP032456.1; note = Pseudomonas savastanoi
gttgagacatccaatctagattctagcttcggcgtacattcctagaatgttgctgccatgatgagttggatactcagctcgtcactgggcgcagactactgctgccctatgtcatagctcctgcttgcggttaagcgctcacgccacagtttggtggtgtggccttccaactgcggcgcgagcactcaccctccgggtgtcaaagtagatgaaggattggacgcctcaac

SEQ ID NO: 15499 - RNA, 230 nt, Pseudomonas sp.
  source 1..230: mol_type = other RNA; note = Related to NZ_CP018420.1; note = Pseudomonas veronii
gttgaggcatccaatctagattctagctccggcgcacgttcctagaatgttgctgccatgatgggttggattctcaactcatcaccgggcgcagaatactgctgccctatgtcttagctcctgcttacggttaagcgctcacgccacagcctagtggcgtagccttctgcccgcggcgcgagcactcaccctgcgggtgtcaaagtagatgaaggattggacgcctcaac

SEQ ID NO: 15500 - RNA, 230 nt, Pseudomonas sp.
  source 1..230: mol_type = other RNA; note = Related to PPEF01000002.1; note = Pseudomonas protegens
gttgaggcatccaatctagattctagcttcggcgtacgttcctggaatgttgctgccatgatgggttggattctcagctcatcaccgggcgcagattactgctgccctatgtcttagctcctgcttgcggttaagcgctcacgccacagcctagtggcgtagccttctgcctgcggcgcgagcactcaccctgcgggtgtcaaagtagatgaaggattggacgcctcaac

SEQ ID NO: 15501 - RNA, 232 nt, Pseudomonas sp.
  source 1..232: mol_type = other RNA; note = Related to CP077977.1; note = Pseudomonas aeruginosa
gttgaggcaaccaatctagattctagcttcggcgtacgttcttcgggacgttgctgccagatgggtcaagcttcacggctcatcaccgggcgcagactactgcagccctatgtattagctcctgcttacggctaagcgctcacgccacagcctagtggcgtaagccttctgcctgcggcgcgagcactcaccctgcgggtgtcaaagtagatgaaggattggaagcctcagc

SEQ ID NO: 15502 - RNA, 233 nt, Pseudomonas sp.
  source 1..233: mol_type = other RNA; note = Related to NZ_LT629756.1
gttgaggcgaccagtctagattctagcatcggcgtgcattcctggaatgttgccgccaagacgagtcaggctttaagactcatctaccgggcgcagactactgctgctctatgtcctagcccccgcttacggttaagcgctctcgccacagttcacgtggcgtggccttcggcctgcggcgggagcactcaccctgcgggtgtcaaagtagatgaaggattggaagcctcaac

SEQ ID NO: 15503 - RNA, 232 nt, Pseudomonas fluorescens
  source 1..232: mol_type = other RNA; note = Related to NZ_CABVIT010000001.1
gctgaggcaaccaatctagattctagctccggcgtgcgttcttagaatgttgccgccaagatgagtaggcttcacaactcatctaccgggcgcagattactgttgccctatgtcctagcccttgcttacggctaagcgctcacgccacagcctagtggtgtatgccttctgcctgcggcgcgagcactcaccctgcgggtgtcaaagtagatgaaggattggaagcctcagc

SEQ ID NO: 15504 - RNA, 232 nt, Pseudomonas sp.
  source 1..232: mol_type = other RNA; note = Related to FNJJ01000006.1; note = Pseudomonas guguanensis
gctgaggcaaccaatctagattctagcttcggcgtacatccttgagatgttgccgccaagatgagtcacgcttcacgattcatctaccgggcgcagattactgctgctctatgtactagcccctgcttacggctaagcgctcacgccacagcctagtggcgtggccttctgcctgcggcgtgagcactcaccctgcgggtgtcaaagtagatgaaggattggaagcctcagc

SEQ ID NO: 15505 - RNA, 231 nt, unidentified
  source 1..231: mol_type = other RNA; note = Related to JAESND010000005.1; note = Jeongeupia naejangsanensis
gttgaggcatccggtctaagcaatctagattcggtgcgcgtcgaagaggacgtaaccaccatcgatgcgcctcggcgtatcgaccgggcacagactactgtcgctctatgtaacagcccccgcttacggctaagtacgcccgccacaaggctacgtggcgaggtcttcggcttgcggcgggcgtactcaccctgcgggtgtcaaagtagatgacagactggaagcctcaac

SEQ ID NO: 15506 - RNA, 229 nt, Chromobacterium sp.
  source 1..229: mol_type = other RNA; note = Related to CP029554.1; note = Chromobacterium phragmitis
gttgaggtctcctgtcaaagaaatctagatccggtgcgcgtcggtatgacgcagccaccattggtgtactttggtacatcaaccgggcgcagactactgccgccctatgtattagctcctgcttacggctaattatgcccgccacagccaacgtagcgaggtcttctgcctgcggcgggcatcatcaccctacgggtgtcaaagtagatgacagactggaaacctcaac

SEQ ID NO: 15507 - RNA, 229 nt, unidentified
  source 1..229: mol_type = other RNA; note = Related to FOZE01000001.1; note = Mitsuaria sp.
gttgaggcatccagtctgaaagtctagattcggtgcgcgtcgagaggacgcagccaccattgatgagcatcggctcatcaaccgggcgcagactactgccgctctatgaaccagctcctgcttacggctaagccctcccgccacaaggttacgtggcgtagccttctacttgcggcgggagacctcacccagagggtgtcaaagtagatggatgattggaagcctcaac

SEQ ID NO: 15508 - RNA, 224 nt, Alcaligenes faecalis
  source 1..224: mol_type = other RNA; note = Related to NZ_CP013119.1
gttgaggcatccagtctaactttctagattcggtgagcgttgagagaacgcagccaccagcgcacttcggtgtgttaaccgggcacagactactgatgctctatgatttagctcccgctcacggtcgagggctccctccacgcacacgtggcgagggcttcggtgcgtggagggagacctcaccctacgggtgtcaaagtagatgaatgattggaagcctcaac

SEQ ID NO: 15509 - RNA, 234 nt, Pseudomonas sp.
  source 1..234: mol_type = other RNA; note = Related to AKJM01000112.1
gttgaggcaaccaatctcagaagtctagattcggtgcgcgttgttgttaaggacgcaaccaccattgatgcgtttcgacgcatcaaccgggcgcagactactgctgctctatgttttagcccccgcttacggctaagcgctcccgccacaaggctacgtggcgagggcttcggcttgcggcgggagccctcaccctgcgggtgtcaaagtagatgacagattggaagcctcaac

SEQ ID NO: 15510 - RNA, 228 nt, Pseudomonas sp.
  source 1..228: mol_type = other RNA; note = Related to NZ_LT629691.1; note = Pseudomonas thivervalensis
gttgagacgaccagtctgaaatctagattcggtgcgcgttgaacagaacgcaaccaccattgatgcgcttcggctcatcaaccgggcgcagactactgccgctctatgatatagcccttgcttacggccaagcgctcccgccacacgcgacgtggcgaggtcttctgcctgcggcgggagccctcaccctacgggtgtcaaagtagatgaaggactggaagcctcaac

SEQ ID NO: 15511 - RNA, 216 nt, unidentified
  source 1..216: mol_type = other RNA; note = Related to NZ_VEHL01000001.1; note = Bordetella sp.
gttgagagcaccggtttttccatctagttgaagaagtggcttcgcgctactgaaccatacttttggtaccggactcagactactgtagatcctctggaatagcatccgcttgcggctaaggttacccgtcactctaccgtggcgaggacttcggatcgtgacgggtaatctcacccccgcgggggtcaaagtagatggaaaactggcgttctcaac

SEQ ID NO: 15512 - RNA, 217 nt, unidentified
  source 1..217: mol_type = other RNA; note = Related to NZ_CP028901.1; note = Orrella marina
gttgagagcgccggttcttttgtctagttgaagaagtggcttcggccatggaaccataccttttggtaccggactcagactactgcagctcctatggaatagcgtctgcttgcggccaaggtcgcccgtcactcttaccgtggcggtgacttcggtgagcgacgggcgatctcacccccttgggggtcaaagtagatggaaaactggcaccctcaac

SEQ ID NO: 15513 - RNA, 214 nt, unidentified
  source 1..214: mol_type = other RNA; note = Betaproteobacteria bacterium; note = Related to JACRAR010000013.1
gttgagggcgccaattattccatctagttgacgccgtggtttcgtgccacggagccatacttcggtaccggactcagactactgcagttctatggaatagcatccgcttgcggctaaggtcacccgtcactagtccgtggcgtggccttcggctagcgacgggtgatctcaccccctcgggggtcaaagtagatggaaaattggcgttctcaac

SEQ ID NO: 15514 - RNA, 214 nt, unidentified
  source 1..214: mol_type = other RNA; note = Related to QUNA01000002.1; note = Paraburkholderia sp.
gttgagggcgccggtttagctatctagttgacgccgcggcttcgtgccacgggaccatacttcggtaccggactcagactactgcagttctatggaatagcatccgcttgcggctaaggtcacccgtcactagctcgtggcgagggcttcggccagcgacgggcgatctcaccccctcaggggtcaaagtagatgggaaattggcgtcctcaac

SEQ ID NO: 15515 - RNA, 233 nt, unidentified
  source 1..233: mol_type = other RNA; note = Related to NZ_KE386569.1; note = Methylobacter luteus
gttgaggtctccttattccaaagtctagatgaagcccactttcttcggagatgtcgggaaccacatggcgctaacgcgccatgaccgggcgcagattgctgtaagccctatgattaagctcacgcttgcggctaaggcctctcgccacaaagctcgtggcggagtcttcggctttgcggcgagaggtctcacccttcgggtgtcaaagtagatggcagattggaaacctcaac

SEQ ID NO: 15516 - RNA, 226 nt, unidentified
  source 1..226: mol_type = other RNA; note = Related to JAIETD010000002.1; note = Methylobacterium sp.
gctgagggagcctcgtgaaatctagtgatcgtcggtggtaactcgccgacggcggtcggttcggtgacgagccgatcggggacggggactaccccgccccttcgagtgagcgtccgcatgctgccaaggctgggcccaccccgaattgcgtcgggtgtctcctgccggggcgggcctagcctcgccagaggcgagtcagagtagatgctcacgaagcgccctcagc

SEQ ID NO: 15517 - RNA, 245 nt, unidentified
  source 1..245: mol_type = other RNA; note = Related to CABVPY010000024.1; note = Burkholderia lata
gctgagacctccggtcaaacgctagcttgtgtcatggcttcggccatgaacctttgtcgagagacgtggcggccgagtaggcctgccttagattgagctcgcgcatagcctgagatcggcgacacgccgcggacgctggcggaaaagtctggctgcgacgtgtcgccgaccacagggcttgcgggctaccgataccgtgacaacacacaaaacagccaaagtagctccagccggatggtttcagc

SEQ ID NO: 15518 - RNA, 229 nt, unidentified
  source 1..229: mol_type = other RNA; note = Related to JAFCZG010000487.1; note = Deltaproteobacteria bacterium
gctgagggcaccacaaattgcatctagttaatgttggactaacaatccagctacagcgtacttggttcatctgggtacgattgtggggagcagattactgctacttcttgtttgagcgggcgcttgcgctaaggtctgtcacgctttgctcttggcgagggtcttgcggcaaaccgcgacagatctcacctaaaggtgtcaaagtagatgtgtagttggtgtcctcagc

SEQ ID NO: 15519 - RNA, 228 nt, unidentified
  source 1..228: mol_type = other RNA; note = Related to NZ_VIKR01000006.1; note = Aliikangiella marina
gctgagggcaccgcaaattgcttctagttaatgttggcctaactagtcaactacaacgtgcttttatctttattgcacgattgaggggtgcagaatactgctactctttgtttgagcgagcgcttgcgctaaggtctatcgcgctttgcgcgtggcgaagacttgcggcaaaccgcgatagaactcacctgacggtgtcaaagtagatgcatatttggtgccctcagc

SEQ ID NO: 15520 - RNA, 228 nt, unidentified
  source 1..228: mol_type = other RNA; note = Porticoccaceae bacterium; note = Related to JAESRL010000013.1
gctgagggcaccaacaattgcttctagttaatgctggctttaaaaaccagttacatcacgcttggttatatccggcgtggttatggggtgcagaatactgctacttcttgtttgagcgtgcgcttgcgctaaggtctgtcgtgctttacgcgtggcggagtcttgcggcaaaccacgacagatctcacctaaaggtgtcaaagtagatgcatagttggtgtcctcagc

SEQ ID NO: 15521 - RNA, 234 nt, unidentified
  source 1..234: mol_type = other RNA; note = Related to NZ_CP034142.1; note = Marinobacter sp.
gttgagggttccagttgatgtatctagttcacgctgaaccggttcttccgggttggcaacagtgtgacacactagatttgtcacacttacggagagcagattactgcgactctatggatgagcttgcgcttgcgctaaggtttgtcgcgctatccacgcggcggggactggcgggcaagcgcgacaaatctcacctaaaggtgtcaaagtagatgcatcgctggaatcctcaac

SEQ ID NO: 15522 - RNA, 215 nt, unidentified
  source 1..215: mol_type = other RNA; note = Related to VENF01000020.1; note = Methylophaga sp.
actgggagtgccggatgactcatctagtgcacgttagattgctaacgacgcttttttcaactgaaaaaagtgggagcggagactactccagcttctcggccaagcccttgctcgtaattaagcgtgtcgcgtctgcgcctgcggcgttaccttcttggcttgccacgacaccatcccctatgggtcagagtagatgagtcgaaagcactctcagt

SEQ ID NO: 15523 - RNA, 216 nt, unidentified
  source 1..216: mol_type = other RNA; note = Related to NZSL01000007.1; note = Methylophaga sp.
actgggagtgccggatgacttatctagtgcatgttagtttactaactacgcttttttctgttgaaaaaagtgggggcggagattacttcagcttctcgggcaagcctttgcttgtggctaagcgtgtcgcgcctgcacctgcggcgttacctccttggcttgtcacgacacctacccctttcgggtctgagtagatgggtcgaaagcactctcagt

SEQ ID NO: 15524 - RNA, 219 nt, unidentified
  source 1..219: mol_type = other RNA; note = Related to NZ_CP013376.1; note = Burkholderia cepacia
tctgaggcggccacgtcaggtctagtgaaaccccatctagcgatagatgggtgggcccctagcaataggagagagccgaagtcggtctctcgcggtggcagcaggcgcattaggcaaaatcagccgaaactgtgccttaacgctcgcggtctcgctgttcagtttcggctgattctgcgaaaaacaattcaaagtagatgaaaacctggtcgcctcaga

SEQ ID NO: 15525 - RNA, 231 nt, unidentified
  source 1..231: mol_type = other RNA; note = Related to QBMO01000003.1; note = Alphaproteobacteria bacterium
tctgagagcgccaaagtgaggtgtttagctcatgccgcacctaacgcgtgcggagcggtgctcgcctgcgagggcgagtggcctcgggcagcagcttctgcttgcctgcgaactagccaacttaagtggcaattcctcagcaaggcactttccggtgcgaagtcttccgccgcgccttgctggggagccgccttcggcggtcaaagtaaatgactccttggcgctctcagg

SEQ ID NO: 15526 - RNA, 231 nt, unidentified
  source 1..231: mol_type = other RNA; note = Related to JABJCF010000323.1; note = Nitrospina sp.
tttgagagcgccaatggagaaatttagctaatgctgtattacataatacagtacggctttctcccgcgagggggaaaagcttcgggcggtggattccacctgcctacgtttaagcagtcttctgttgcaaaatatagccaagccactagttggtgcgaagtcttccctagtgccttgcctattttccgcataaaccgcggtcaaagtaaatgactccttggcgctctcgat

SEQ ID NO: 15527 - RNA, 235 nt, unidentified
  source 1..235: mol_type = other RNA; note = Related to NZ_FOYI01000015.1; note = Poseidonocella sedimentorum
gttgagagcgccaaagtgaaccatttagcaaacgcggccagtgtagactggcagcggataggcgaatgcttgaaagagcacacggcctcgggtgaaggattccgcaagcccgcgatgaagctcactacagcgtcaaactacaaggaaagacacgctgacgtcgaagtctcctacgtgtcttcccttgtcgtcgccccaaggggctcgaagtaaatggaaccgtggcgctctcagc

SEQ ID NO: 15528 - RNA, 233 nt, unidentified
  source 1..233: mol_type = other RNA; note = Related to JAHLLJ010000012.1; note = Deltaproteobacteria bacterium
tttgaggatgccacatggataatctagttttcgctggttcgctaaccagtggcgatggacctgtaagagggttcattttggagcgcagattgctgcgtctctacgaaatagcctttgcttctgaacaaggctaggaacgtcgtgcgacgctacgtcctgcggagccttgctgcacgacgttcctaccctcgcccttcgggcgtcaaagtagattaacatgtggcatcctcatt

SEQ ID NO: 15529 - RNA, 225 nt, unidentified
  source 1..225: mol_type = other RNA; note = Related to JACHBD010000013.1; note = Rhizobium lentis
gttgagggttccccgcgatgtctagtggatgtcgattcgaaaggattggcaccgatgggccttcgggccctgggccgtcgattacgacgtgttcgcgatcaagcgtccgcttgatgatatccttgatcgaaacgtacggccatggccgccgcagcgcacgtctcgcttacgtctcgatcaacgaaaccctatgggggtcaaagtagatggcgtggaactctcaac

SEQ ID NO: 15530 - RNA, 225 nt, unidentified
  source 1..225: mol_type = other RNA; note = Related to JAAXSV010000011.1; note = Rhizobium laguerreae
gttgagggttcctcgcgatgtctagtggctgtcgattcgtgaggatcggcaccgacgggccttacagccctgggccgtcgattacgacgtgttcgcgatcaagctcccgcttgatgatatccttgatcgaaacgtacgtccaaggccggcgcagcgcaagtctcgcttacgtctcgatcaaagacaccctaaaggggtcaaagtagatggcgtggaactctcaac

SEQ ID NO: 15531 - RNA, 225 nt, unidentified
  source 1..225: mol_type = other RNA; note = Related to WUFA01000001.1; note = Rhizobium leguminosarum
gttgagggttcctcgcgatgtctagtggctgtcagttcgagaggattggcaccgacgggccttcgggccctgggccgtcgattacgacgtgttcgcgatcaagcgtccgcttgatgatatccttgatcgaaacgtacgaccgaggtcgccgcagcgcatgcctcgcttacgtctcgatcaaagacaccctatgggggtcaaagtagatggtgtggaactctcaac

SEQ ID NO: 15532 - RNA, 246 nt, unidentified
  source 1..246: mol_type = other RNA; note = Related to NZ_VNHV01000015.1; note = Maritimibacter alkaliphilus
gttgagagcgccacgcgatgtctagtggttgccggggtaacgaccggcaccgttggtgtcacgtcctgcccgcaggaggtgatgcctgggccgtcgattgcgatgggctcacggtcaagctttcgcttgatgctcaacttgatcgaaccgcacgaccttgcggtcgccgcagcggtaggctgacttgcgatccgatcaagctcaccctgaagggtggatagtagatgcgaacgtggaactctcaac

SEQ ID NO: 15533 - RNA, 238 nt, unidentified
  source 1..238: mol_type = other RNA; note = Related to NZ_PGOI01000009.1; note = Pseudorhodobacter sp.
gctgagaatgccgcgcgatgtctagtggttgccggttgcggcaccgttggggccatcgttcagcgatggacgaggtctctgggccgtcgattgcgacgtgctcacggtcaagctggtgcttgatgctaacctcgatcgaagcacacgacctgcggtcggcgctgcgcgtgcctcgcttgtgctccgatcgaggtcaccctgtcgggtgaatagtagatgaacgattggcattctcagc

SEQ ID NO: 15534 - RNA, 228 nt, unidentified
  source 1..228: mol_type = other RNA; note = Related to QOCE01000045.1; note = Phaeobacter gallaeciensis
gttgagaccgccacgaagggcttttggatgacgccggttgcaagagccggcgccgatgttcggttgagaaatcggatattgtgggcagcagattctgcgcgccttcggactagctttcttgtagcgctgacgtggatcgcgccgtgccacgatgcgcggcctttctacacggcgcgatccgcaccacccttgcggagtcgaagcaaatgactctctggcggtctcaac

SEQ ID NO: 15535 - RNA, 228 nt, unidentified
  source 1..228: mol_type = other RNA; note = Related to JAGHRB010000006.1; note = Ruegeria sp.
gttgaggccaccaagaaggaaatttggatgatgtcggctgcaagagccgacgccgaaatccggtcgaaagaacgggttttatgggcagcagaatctgcgtgcctgcggaatagcttccttgccgcgctgacgtggatagcgccgtgcgacgatgcgcggcctttctgcacggcgctatcctccccatccttgcggagtcaaagcaaatgactgcttggcggcctcaac

SEQ ID NO: 15536 - RNA, 227 nt, unidentified
  source 1..227: mol_type = other RNA; note = Related to CP036420.1; note = Cereibacter sphaeroides
gttgaggccgccatgttgagggtatctggatgacgccggtcgcaagggccggtgccgatgttggacgaaagtcgagcatactgggcagcagaatctgcgcgccttcggaaaagcttccttgcagcgctgacgtggatcacgccgcatcacggtgcggggtcttcctatgcggcgcgatcctccccaccagaggtggtcaaagcagatgacctcttggcggcctcagc

SEQ ID NO: 15537 - RNA, 223 nt, unidentified
  source 1..223: mol_type = other RNA; note = Related to LR743509.1; note = Hyphomicrobium sp.
gctgagaccgccgaagagtctatttagatgatgctggggcgagagccctggcaccgccggccgcaaggccggaggcggggcgcagattctgcgaccctacggaaaagctcgcttcggcagctgatcatcgtcgagctcgctctcggatcggtgtcttcccgcgcgaactcgacgatcctcaccctacgggtgtcaaagtaaatgaccatttggcggcctcagc

SEQ ID NO: 15538 - RNA, 226 nt, unidentified
  source 1..226: mol_type = other RNA; note = Related to NZ_JACHCP010000006.1; note = Rhodanobacter sp.
tctgagggcgccacgtgtctgagtttaggtatgccccatggaatacttaggtattcttagacgaagcgatttttcgtcaggatctggctacttgccgggtctttggaaaagcaggtgcttgcgtgcaagacacctagcgacgggacggctggcggagtcttgcctagcgtcgctaggcggctcgcccgttgggcgtcaaagtagatgaggtcgtggcgtcctcaga

SEQ ID NO: 15539 - RNA, 206 nt, unidentified
  source 1..206: mol_type = other RNA; note = Related to PZOX01000020.1; note = Vitiosangium sp.
tttgagggccgccaagaggacatcttagcgttccccaccggattccggtgggcccatacggaaactcggatactgagtttcttggaagtagcccccgcaatggcgcaaggtgcggtgaagcccgcctggtccgacgtgcgcctgggtcggtcttcaccgtacctcgctccgcagtcaaagtaagatgtcctcttggcgccctcatc

SEQ ID NO: 15540 - RNA, 204 nt, Pseudomonas sp.
  source 1..204: mol_type = other RNA; note = Related to NZ_VJOY01000004.1; note = Pseudomonas mangiferae
gctgagggctccgctgtagcggaatctagtatcccgcacattgtgcggggcgtttttgggagcaaactatgcttaccgttgaacgatctcacgcctactggagggcggcaggctccatggtgttcgctatcgaagtctggcgccagaagcctgccatccgccagggcggaatttaaaggtagatgagtcgctggagctctcagc

SEQ ID NO: 15541 - RNA, 204 nt, Pseudomonas sp.
  source 1..204: mol_type = other RNA; note = Related to NZ_JH635998.1
gctgagggctccgcagtagcggaatctagtatcccgcgcgttgcgcggggcgtttttgggagcaaactatgcttaccgtcggacgatctcacgcctactggagggcggcagccttcatggtgttcgctatcgaagtctggcgccagaaggctgccatccgccagagcggaatctaaaggtagatgaatcgctggagctctcagc

SEQ ID NO: 15542 - RNA, 204 nt, Pseudomonas sp.
  source 1..204: mol_type = other RNA; note = Related to NZ_CP007637.1; note = Pseudomonas simiae
gctgagggctccgcagtagcggaatctagtattcccgcgcgttgcgcggggcgttttgggagcaaactatgcttaccgtcgaacgatctcacgcctgctggaggttggcagccttcatggtgttcgctatcgaagtctggcgccagaaggcttccatccgccagggcggaatctaaaggtagatgagtcgctggagctctcagc

SEQ ID NO: 15543 - RNA, 201 nt, Pseudomonas sp.
  source 1..201: mol_type = other RNA; note = Related to CP031146.1; note = Pseudomonas plecoglossicida
gctgagggctccgcagtagcggaatctagtatcccgcacgatgtgcgggcgttaagggagcaaattatgcttgccgtcgaacgatctcacgcttccaggaggtataagccttctacggctcgctatcgaagtcttgcggcaagaaggcttatatccgccagggcggagcttgaaggtagatgactcgctggagctctcagc

SEQ ID NO: 15544 - RNA, 204 nt, Pseudomonas sp.
  source 1..204: mol_type = other RNA; note = Related to NZ_JAHSTV010000019.1; note = Pseudomonas farris
gctgagggctccgcagtagcggaatctagtatcccgcgcgttgcgcggggcgttattgggagcaaactatgcttaccgtcgaacgatctcacgcctactggagggcggcagccttcatggtgttcgctatcgaagtctggcgccagaaggcttccatccgccagggcggaatctaaaggtagatgaatcgctggagctctcagc

SEQ ID NO: 15545 - RNA, 202 nt, Pseudomonas sp.
  source 1..202: mol_type = other RNA; note = Related to NZ_CP085704.1
gctgagggctccgcagtagcggaatctagtatcccgtgcgttgtgcgggacgataagggagcaaattatgcttgccgttggaacgatctcacgcctaccggaggtgggaaccttcctttactcgctggcgatgtctggcgatcagaaggctccctccgccagggcggaatctaaaggtagatgaatcgctggagccctcagc

SEQ ID NO: 15546 - RNA, 201 nt, Pseudomonas sp.
  source 1..201: mol_type = other RNA; note = Related to NZ_CP061943.1
gctgagggctccgcattagcggaatctagtatcccgcacgttgtgcgggcggcttgggagcaaattatgcttaccgtcgaacgatctcacgcgtactggaggttggcagccttcgtggtgttcgctatcgaagtctggcgccagaaggcttccatccgcagggcggaattcaaaggtagatgacccgctggagctctcagc

SEQ ID NO: 15547 - RNA, 202 nt, Pseudomonas sp.
  source 1..202: mol_type = other RNA; note = Related to NZ_UVZC01000005.1; note = Pseudomonas viridiflava
actgagggctccgcagtagcggaatctagcatcccgcacgttgtgcgggcgttaagggagcaaactatgcttgccgtcgaacgatctcacgcttccaggaggtataagccttctcaggctcgctatcgaagtcttgcggcaaagaaggctcatatccgccagggcggaatctaaaggtagatgactcgctggagccctcagt

SEQ ID NO: 15548 - RNA, 202 nt, Pseudomonas sp.
  source 1..202: mol_type = other RNA; note = Related to CP024630.1; note = Pseudomonas aeruginosa
actgagggctccgaagtagcgaaatctagcaccctgcactctgtgcaggacgtttagggagcagactctgcttacccatggaacgatctcacgctgacaggaggttggggaccataaaattacgctacgatgtcttgcgattttacggtccccatccgccagggcggaatctaaaggtagatgaaacgctggagccctcagg

SEQ ID NO: 15549 - RNA, 203 nt, Pseudomonas sp.
  source 1..203: mol_type = other RNA; note = Related to NZ_AVEP02000116.1; note = Pseudomonas avellanae
actgagggcttcgcaatagcggaatctagtatcccgcactctgtgcgggacgtttagggagcaaactctgctttccgttggaacgatctcacgctgacaggaggttaagagcctgaaaattacgctatcgatgtctggctattttaaggctctcatccgccagagcggaatctaaaggtagatgaaacgctggagccctcagt

SEQ ID NO: 15550 - RNA, 204 nt, Pseudomonas sp.
  source 1..204: mol_type = other RNA; note = Related to MKGS01000151.1
gctgagggccccgcagtagcggaatctagtaccctgcacgctgtgcaggacgttaaagggagcatattttgctttccgtaggaacgagctcacgctttccgttggttaagagcctcaaaatcacgcaaacgaggtcttgctatttcgaggctctcatccgccagagcggaatctaaaggtagatgaatcgctggagccctcagc

SEQ ID NO: 15551 - RNA, 200 nt, Pseudomonas sp.
  source 1..200: mol_type = other RNA; note = Related to NZ_FYDX01000020.1
gctgagggctcccacttagcgaaatctagaatcctctagactctagaggctgtaggaagcaggttatgctgtccataggaagaacccccgcaaaacaggaggttgagcacctcgttcctacgctggcgttgtcttgcgatctcgaggcgctcatccgcctgggcggaatctaaggtagatgaatcgctggagccctcagc

SEQ ID NO: 15552 - RNA, 201 nt, Pseudomonas sp.
  source 1..201: mol_type = other RNA; note = Related to NZ_CP061723.1; note = Pseudomonas putida
gctgagggctccaacttagcgaaatctagaatcctctagactctagaggctgtaggaagcaggttatgctatccataggaagaacccccgctgaacaggaggttgagcgcctcgctcttacgctggtgtatgtcttgcggtctcgaggcgctcatccgcctgggcggaatctaaggtagatgaatcgctggagccctcagc

SEQ ID NO: 15553 - RNA, 203 nt, Pseudomonas sp.
  source 1..203: mol_type = other RNA; note = Related to NZ_LHVL01000030.1
gctgagagctccgatttagcggaatctagaatcctctgcaattggtagaggctgtaggaagcaggctatgctgtccgatggaagaacattcgcattacaggaggttgggtacctcgcatcttcgccggcggagtcttgcgggcttcgaggcacccatccgccagagcggaatctaaggtagatgaatcgctggagctctcagc

SEQ ID NO: 15554 - RNA, 201 nt, Pseudomonas sp.
  source 1..201: mol_type = other RNA; note = Related to JACVBX010000001.1
gctgagagctccgttttagcggaatctagaatcctctagtaaatagaggctgtaggaggcaggatatgctgtccgaaggaagaactgacgcttcatgggaggatgtgtgcctcgagcctacgcaggcgatgtctggcggtcgcgaggcgcacttccgcccttggcggaacctaaggtagatgactcgctggagctctcagc

SEQ ID NO: 15555 - RNA, 206 nt, unidentified
  source 1..206: mol_type = other RNA; note = Related to NZ_CAKLIV010000056.1; note = Pectobacterium versatile
tctgagagctccgagagcttgaatctaggctcctccaatacttttggaggctgatagggcagctaattgctaaccctcaggttgaactggcgcttacagggaattcacaactcattctactcgtttacgtaagccttacgatcacgagttgtgcattcgctgccgcgaatggaatctaaagtagatgaactcttggaactctcaac

SEQ ID NO: 15556 - RNA, 202 nt, unidentified
  source 1..202: mol_type = other RNA; note = Related to JACVUO010000002.1; note = Pantoea sp.
attgagagctccgtatccttgagtctagtatcctccttaatttggagggctgaggggcaaccaatggtttcccatagtttgaactgacgcatactgggaatacacaactcacacctgtcgccgacgtatgccttgcggctgtgagctgtgcattcgctgcgcgaatggagtctaaggtagatgaagatatggagccctcact

SEQ ID NO: 15557 - RNA, 200 nt, Pseudomonas sp.
  source 1..200: mol_type = other RNA; note = Related to NZ_LPNO01000008.1
gctgcgggctccagtttaaaggaatctagcaatctccccctgctgggagctattagggcacatgttttgtgtaccgaaggacgatccaacgcttacaggaggatccacgactcttcacttggcgctacggagccttgctgcttgagtcgcgcttccgcctgagaggaatcaaaggtagatgaccaactggagcccgcagc

SEQ ID NO: 15558 - RNA, 200 nt, Pseudomonas sp.
  source 1..200: mol_type = other RNA; note = Related to NZ_LIGO01000012.1; note = Pseudomonas corrugata
gctgcgggctccaacttagtggaatctagcaatctccccctagttgggagctactaggacacatactttgtgctccgaaggacgatctaacgcttacaggaggttttctcgactttcacgggcgctacggtgccttgctgttcaagtcgaaaatccacctgcttggaatcaaaggtagatgaccaattggagtccgcagc

SEQ ID NO: 15559 - RNA, 230 nt, unidentified
  source 1..230: mol_type = other RNA; note = Related to NZ_CP014579.1; note = Paraburkholderia phytofirmans
gctgagagcgtccggataatcaccatctagcgtatccctcgttctacggggcgagggcttgatctcgggcgaccgaggtctcagggcactggattaccggtgctcgatggcagaacttgcgcttactggagtaacccaccaccacacgaccagcgtcgtggcctcgcggcgatggcggtgggtttcgccagggcgaattcaaaggtagatggtgaactggcgctcccagc

SEQ ID NO: 15560 - RNA, 223 nt, unidentified
  source 1..223: mol_type = other RNA; note = Related to NZ_CADETV010000001.1; note = Burkholderia anthina
gctgagggcgtccaaatagtcaccacctagtgtatccctccttcgggagggctcgatctcgggtgactgagatctcagggtactggattaccggtgcttgatggcagaacttccgcttactggagtaacccaccaccagcgaccagcgtcgtggccttgcggcattggcggtgggtttcgccagggcgaattcaaaggtagatggtgaactggcgcgctcagc

SEQ ID NO: 15561 - RNA, 225 nt, unidentified
  source 1..225: mol_type = other RNA; note = Related to QBTZ01000001.1; note = Acidovorax sp.
gctgagagtaccgatttagtgatagtctagtttccatagggaggcaactccctgtggtcgagccgtagcttttgctgtggcgaggcttaggagtccgaaagccgaatttgaacttgcgcctacttgcgccgtctcctgcagctggctaccagcgtgtcctcgggccagagcaggagacgtcccgcgagcgggaccaaaggtagatgaaccactggaactctcagc

SEQ ID NO: 15562 - RNA, 228 nt, unidentified
  source 1..228: mol_type = other RNA; note = Related to NZ_LMHZ01000013.1; note = Noviherbaspirillum sp.
gctgagagagccgtattagtggaaagctagaatccataaggggtaacccttgtggctgaaccttagctatatgttgaggtgaggtgtaggatgtccgaacaccaatgattgaaccggcgccaacttgaggacgcctcccgagtctggctaccagcgtaacctcgggtcagatcgggaggcgccccgcaaggcggggccaaaggtagatgaaccactggcaatctcagc

SEQ ID NO: 15563 - RNA, 223 nt, unidentified
  source 1..223: mol_type = other RNA; note = Related to CABFMN010000087.1; note = Xylophilus ampelinus
gctgagagacccggtgtagaaaatctagtgtcccctggctatgtccagggaggcggacccgagtgatcgggtctgcgggacgcggattccgcgcaacctcggacgaactgccgctttactggaggatcagaaccgccaacactcgccgcgtggccttgcggttctggcggtcctggcccgccagggcgggctcaaaggtagatgacttcctgggactctcagc

SEQ ID NO: 15564 - RNA, 213 nt, unidentified
  source 1..213: mol_type = other RNA; note = Related to NZ_VUYU01000002.1; note = Massilia rubra
gctgaggttgccgtctacatccatttagtcaccgcctgtgctgttcggcaggcaggggaccggattcccgcgtcccttaaaagaaactcacgctttacggaacctttgagcctcgctcagaggcttcgctgtggatgtcttgctcatgagcgagtctcaaaccctccatgaatgtcaacaagtgtaaatgaatgacacactggcaatctcagc

SEQ ID NO: 15565 - RNA, 213 nt, unidentified
  source 1..213: mol_type = other RNA; note = Related to NZ_WKJJ01000024.1; note = Massilia rivuli
gctgagattgccgtcaaaatccatttagtcacggcctatgctgttggtaggcagggggccggattcccgcgccccttgagaggaacttacgctttacggaacctttgagcctcgctcaaaggcttcgcggtggatgtctggcgaatgagcgaggctcaaatcctccatggaatgtcaacaaatgtaaatgaatgagtaattggcaatctcagc

SEQ ID NO: 15566 - RNA, 224 nt, unidentified
  source 1..224: mol_type = other RNA; note = Deltaproteobacteria bacterium; note = Related to JAAUUP010000100.1
ggtgcaggcgaccacgccacgactagcggctctccggagcgggatacacttctgtgttcccaggcaacgcggattgctgcgttgctttgataaatcaagcgcttgtaaggcctccggcccgatcgacgcccgcgagctcctcgcagccttggcgcttggcgccgatcgagcccgagctaacgctcggtcgacgtagggggtagttgtggcgtggtcaccgcacc

SEQ ID NO: 15567 - RNA, 214 nt, unidentified
  source 1..214: mol_type = other RNA; note = Related to JAIUHI010000001.1; note = Mesorhizobium sp.
gttgagggctcggtgagggagtttagaaatgcgccgcgcaagcggcgacgggttcctggggaacctggggctagggatttcccgggtccatacatcggagcaggaccttcgcgctgcgcgagacagcaagtcacggctggcggagtcttggacgagacttgctatcccacccacctgagtgggtcgaagtagatgtccgcaccgagccctcaac

SEQ ID NO: 15568 - RNA, 214 nt, unidentified
  source 1..214: mol_type = other RNA; note = Related to JAAYVT010000069.1; note = Phyllobacteriaceae bacterium
gttgagggcccggtgaagagatttagaaatgcgccgcgcaagcggcgatgggttccgtgggaacccagggccagggatttcccgggtccgtgcatcggagcaggaccttcgcgctgcgcgagacaacaactctcgactggcggggtcttggacgagacttgctgtcccacccacctgagtgggtcgaagtagatgtctacgccgagccctcaac

SEQ ID NO: 15569 - RNA, 214 nt, unidentified
  source 1..214: mol_type = other RNA; note = Related to NZ_VCDI01000012.1; note = Lichenicoccus roseus
gttgagggcccggtgagggcatttagaaatgcgccgcgcaagcggcgtctggtcccttggggacctggggcttgggattccctgagcccgcgcatcggagcaggaccttcgcgctgcgcgagacagcaagtctcggctggcggagtcttggacgagacttgctgtcccacccaccccggtgggccgaagtagatggcagcgccaagccctcaac

SEQ ID NO: 15570 - RNA, 214 nt, unidentified
  source 1..214: mol_type = other RNA; note = Related to NZ_CP010954.1; note = Sphingobium sp.
gttgagggctcggtgacagcatttagaaatgcgccgtgcaagcggcgacggttccctcggggagccggggtccaggatttccggggtccacacattggagcaggaccttcgcactgcgtgagacagcgagtctctgcgggcggggtcttggttgatactcgctgtcccacccaccatggtgggtcgaagtagatgcctgttccgagtcctcaac

SEQ ID NO: 15571 - RNA, 214 nt, unidentified
  source 1..214: mol_type = other RNA; note = Related to NZ_BAJW01000019.1; note = Acetobacter persici
gttgagggcccggtgacgccatttagaaatgcgccgtgcaagcggcgactgatcccttggggatctgggactccggattcccggagttcgcacatcggagcaggaccttcgcactgcgtgagacagcaagtctcggctggcggggtcttggttgagacttgctgtcccacccacctcggtgggtcgaagtagatgccagtgccgagtcctcaac

SEQ ID NO: 15572 - RNA, 214 nt, unidentified
  source 1..214: mol_type = other RNA; note = Related to NZ_SLXP01000012.1; note = Rhodovulum marinum
gttgagggctcgatgacgtggtctagaaatgcgctgcttcggcagcgacgggtcccttgggggcctggaacgtcggatttccgacgttcgcaaagaggagcggagtattcacgctgcgcgatactgcacgtcacgcctggcggtgtcttggccgcgacgcgcagtaccacccacccgggtgggtcaaagtagatgccggcgccgaaccctcaac

SEQ ID NO: 15573 - RNA, 214 nt, unidentified
  source 1..214: mol_type = other RNA; note = Related to JACIJP010000010.1; note = Sphingobium subterraneum
gctgagggctcggtgagggggtctagtaatgcgccgcttcggcggcgactggtccttttgggacttggggcatcggactaccggtgctcgttagaaggagcggaatattcacgctgcgcgatgctgcgaataacgcctggcgaagtcttggccgatatccgcagtatcacccacctgggtgggtcaaagtaggtgtcgttgccgagctctcagc

SEQ ID NO: 15574 - RNA, 214 nt, unidentified
  source 1..214: mol_type = other RNA; note = Related to JFYY01000007.1; note = Sphingomonas paucimobilis
gctgagggctcggtgagcgggtctaggaatgcgccgcttcggcggcgacgggtccttttgggatctggggcgctggattaccggcgtccgctaggcggagcgaagtattcacgctgcgcgataatgcacgtcgtgcctggcgaagtcttggtcgcgacgcgcattaccccccacccgggtgggtcaaagtagacgatgccgccgggtcctcagc

SEQ ID NO: 15575 - RNA, 214 nt, unidentified
  source 1..214: mol_type = other RNA; note = Related to NZ_JACONT010000017.1; note = Sphingomonas albertensis
gctgaggagtcggtgaggccggctaggaatgcgccgcgcgagcggcgactggtcctcttgggatctggagcgtcggatttccggcgttcgaaaagtggagctgggccttcgcgctgcgcgagactgcacgtcacgccggtcggggccttggttgcgacgcgcagtcccaccccccggggtgggtcgaagtagatgcccgcgccggctcctcagc

SEQ ID NO: 15576 - RNA, 213 nt, unidentified
  source 1..213: mol_type = other RNA; note = Related to NZ_BPQL01000193.1; note = Methylobacterium goesingense
gctgagggatcggtgattctatctaggaatgcgtcgcggaagcgacgacggttcttgaaggaactggagcgccggatttcaggtgctcggaaagcggagcgtccctattacgctgcgcgttacagcaagcatcacctcgcgccgtcttgggcgatgctcgctgtttcacccacccaagtgggccaaagtagatgaacttaccgaaccctcagc

SEQ ID NO: 15577 - RNA, 214 nt, unidentified
  source 1..214: mol_type = other RNA; note = Related to NZ_CP030037.1; note = Bradyrhizobium sp.
gctgagggcccggtgagggcgtctaggaatgcgccgcgagagcggcgacgggctcctcgggggcctggggcaggggatttcccatgtccgcaaagcggagcgttatcttcgcgctgcgcgttactacgagacacgcctggcggcgtcttggtcgagcctcgtagtatcacccaccatggtgggtcgaagtaggtgtccctactgagctctcagc

SEQ ID NO: 15578 - RNA, 213 nt, unidentified
  source 1..213: mol_type = other RNA; note = Related to FNXB01000037.1; note = Rhizobium tibeticum
gctgagggctccatgagggtgattaggaatgcgccgcgaaagcggcgatgggcatcacggatgtccagagtaccggattctcgatgctcgtctcgcgtagcgacattttcatgctgcgcaatggcacgagcctttcccggcggcgtcttgggggcgcctcgtgccattacccaccgaatggggtcaaagtaatgcaatcgtggagccctcagc

SEQ ID NO: 15579 - RNA, 213 nt, unidentified
  source 1..213: mol_type = other RNA; note = Related to RPNF01000004.1; note = Sinorhizobium meliloti
gctgagggctccatgagggtgattaggaatgcgccgcggaagcggcgatgggcatcctggatgtccagagcatcggattctcgatgctcgtctcgcgtagcgacattttcatgctgcgcaatggcacgagcctttcccggcggcgtcttgggggcgcctcgtgccattacccaccgtatggggtcaaagtaatgcaatcgtggaaccctcagc

SEQ ID NO: 15580 - RNA, 216 nt, unidentified
  source 1..216: mol_type = other RNA; note = Related to LXKM01000017.1; note = Agrobacterium sp.
gctgagggccccatgacagtagttaggaatgcgccgcgaaagcggcgatgggcgtcgttgtggatgcctagggtatcggattctcggtactcgtctcgcgtagctactttttcatgctgcgcaatactgcgagccttgcctggcggtgtcttggttgcgcctcgcagtattacccaccgatttgggtcaaagtaatgcagtcgtggagccctcagc

SEQ ID NO: 15581 - RNA, 213 nt, unidentified
  source 1..213: mol_type = other RNA; note = Related to NZ_QJKM01000019.1; note = Rhizobium terrae
gctgagggctccatgacagcgattaggaatgcgccgcggaagcggcgatgggcaccacgggtgtccagagcatcggattctcgatgctcgcttcacgtagcttgtttttcatgctgcgcactggcacgagcctttaccggcggcgtcttaggtacgcctcgcgccagtacccaccgaatggggtcaaagtaatgcaagcatggagccctcagc

SEQ ID NO: 15582 - RNA, 217 nt, unidentified
  source 1..217: mol_type = other RNA; note = Related to PEGF01000002.1; note = Caulobacter sp.
gctgagggttccttgagggcaattaggaatgcgccgcgaaagcggcgatgggcttcttcgcggaagcctagggcgtcggattctcggcgctcgtctcgcgtagctctcttttcatgctgcgcaatactgcaagcctttcctggcggtgtcttgggtgcgccttgcagtattacccaccggagtgggtcgaagtaagtgtcgtcctggaaccctcagc

SEQ ID NO: 15583 - RNA, 216 nt, unidentified
  source 1..216: mol_type = other RNA; note = Related to NZ_NEFY01000006.1; note = Marinobacter vinifirmus
gctgagggctctatgaaagagattagatatttgccacgaaagtggcaaggggttccttctgcggagcccagggtatgggagttcctgtgctcagatcgcggagcagtcttttcatgctgcgcttcagtgcgatctagcccgggcgatgtcttagggctagatcgcactgatccccaccgaggtgggtcaaagtaatgtctttctggagtcctcagc

SEQ ID NO: 15584 - RNA, 216 nt, unidentified
  source 1..216: mol_type = other RNA; note = Related to NYXE01000056.1; note = Rheinheimera sp.
gctgaggacttcatgatcgagattagacatttgtcacgagagtggcaaggggttctgtttttgggaccctggatgcgggagttcctgcattcgtttcgcggagctgtattttcatgctgcgcattagtgcgcgttagcccaggcgacgtcttcaggctaacgcgcactaatccccaccgaggtgggtcaaagtaatgtcttcatggagttctcagc

SEQ ID NO: 15585 - RNA, 216 nt, unidentified
  source 1..216: mol_type = other RNA; note = Related to NZ_JACHOW010000011.1; note = Longimicrobium terrae
gctgagggctccatgaccgggattagtactgcgccgcgaaggcggcgctgggctttcatcgcaaagttcagggtgcgggagttcccgcacccatctcgcggagctctgtattcatgctgcgcagcagtccaactctggcctggcggggtcttggtccagactcgcactgtcacccacccggggtggtcaaagtaatgccggcatggaaccctcagc

SEQ ID NO: 15586 - RNA, 211 nt, unidentified
  source 1..211: mol_type = other RNA; note = Related to NBDP01000036.1; note = Bosea sp.
gttgagggctccgtagtgtcgtctagcaatgcaccgcgcaagcggtgccgggtttcacaacccgggatgcgggatttccggcattcgtcaaaaggagctgagccttcgcgctgcgcgaggcagcaagcaaaaccaggcggtgtcttgggccttgctcgctgtctcccccacctatgtgggccgaagtagatgcgcattacgagccctcaac

SEQ ID NO: 15587 - RNA, 211 nt, unidentified
  source 1..211: mol_type = other RNA; note = Related to RCIZ01000007.1; note = Mesorhizobium sp.
gttgagggctccgtagtgacgtctagcaatgcaccgcgagagtggtgccgggctttcgggcctggaatgcgggatttccggcattcgttaagcggagctgatccttcgcgctgcgcgaggcaacaagaaacaccggtcggtgtcttcggccttcctcgctgcctcccccacctatgtgggccaaagtagatgcgcattacgagccctcaac

SEQ ID NO: 15588 - RNA, 214 nt, unidentified
  source 1..214: mol_type = other RNA; note = Related to NZ_JAHVKC010000001.1; note = Pseudooceanicola nitratireducens
gttgagggcgccgtgaggccgtctaggaatgcactgcgcagccagtgctgggtctgttacgacccagggtgttggatttccggcgctcgtaaagcggagcaggttcttcgcgctgcgcggtatggcaagcaaagcctgtcggtgtctccggcagtccttgccataccccccaccttaggtgggccgaagtagatgcgccaaacgagccctcaac

SEQ ID NO: 15589 - RNA, 214 nt, unidentified
  source 1..214: mol_type = other RNA; note = Related to WIEL01000040.1; note = Rhizobium leguminosarum
gctgaggattccgtgatgtcatttagcatagcgccattaacgtggcgccgggtccacatgtttgggcccggggaatcggatttccgagaccctttgaaggagcgaagatttacgctgcgcgatcaccaaagcatcttgggcggtgtcttgggcgcttcttcggtgttcccccaccccgagtggtcaaagtagatggctcgctggaatcctcagc

SEQ ID NO: 15590 - RNA, 214 nt, unidentified
  source 1..214: mol_type = other RNA; note = Related to NZUJ01000046.1; note = Ponticaulis sp.
gttgagggctcggtgatacgatttagcatttcgtggcacttgccacggttggccctcgcgggcatggggaatgggatttcctgttctctgccagaagaacacacatatttcgcttcgcgtctgttgaaacacagagcggcgaagtcttactttgtgttccaacagtcacccaccacaggtgggacgaagtaaatgcgttttccgagccttcaac

SEQ ID NO: 15591 - RNA, 247 nt, unidentified
  source 1..247: mol_type = other RNA; note = Related to NZ_JABVZR010000001.1; note = Novosphingobium sp.
tctgagggttccacggtagcatctagctattgtcatccgagagggtgaccgtgatggtggatacgaatccattgtcgtggggaatggagttttccattgccgttgaaagagcacgtgaatgcaggtccacgccggatcatccatcattgcccttcgggcaacctcctcggaacggctcggtttgatggacgatccggcgccgccagggccgcgctaaagtagatggctcatccgtgggatcctcaga

SEQ ID NO: 15592 - RNA, 247 nt, unidentified
  source 1..247: mol_type = other RNA; note = Related to JAALZB010000008.1; note = Agrobacterium tumefaciens
tctgagggttccaaaaggtagcatctagctactgccacccgcaagggtggccaggatgatgagtacgaacttatcgtcatggggaatagggtttcttattgccgctgaaagagcacaagaatgcaggtccacgcaggatcatccatcattgccctttgggcaacctcctcggaggctcggtttgatggacgatcctgcgccgccagggccgcgctaaagtagatggctcaccgttgggaccctcaga

SEQ ID NO: 15593 - RNA, 245 nt, unidentified
  source 1..245: mol_type = other RNA; note = Related to VFSZ01000005.1; note = Mesorhizobium sp.
tctgagagtcccacgctagcgtctagctattgtcatccttcgggatggccgtgatgatggatacgaatccattgtcttggggaatggagttttccattgccgctgaaagagctcgtgaatgcaagtccacgtcgcgtcatccatcgttgcctttcaggcaacctcctcggaggctcatttcgacggacgacgcgacgccgccagggccgcgctaaagtagatgccgtatcgttgggactctcagg

SEQ ID NO: 15594 - RNA, 245 nt, unidentified
  source 1..245: mol_type = other RNA; note = Related to NZ_QDKO01000010.1; note = Caulobacter sp.
actgagggctccacggctcttgtttagcgcccgccgctcttcggagcggccgtgatggtcggtacgaaccggctatcgtgggtgatcgggtttccggtcgccgttgttagagctgccgatcgcaggtccacgtcgcttcctccttcgttcctttcaggaacctcctcgtgaggctcggttcgaaggacgaagcgacgccgccaggcctgggttcaagtagatgagacacccgtggagctctcagc

SEQ ID NO: 15595 - RNA, 244 nt, unidentified
  source 1..244: mol_type = other RNA; note = Related to PCOO01000001.1; note = Ochrobactrum sp.
gttgagagacccaagggtgtcatttagcaaccgccgcctcacgaggcggccaaggtgacccgctttggtgtaggtcgccttggcggcagggtttcctgtcgccgtagatggagctgtcgaatactggtatcctacccagcgcgtcagtcgcgagcgacacattcggcaagcgtcgaaatgaacccgctgggcaggacaccccacaggggtgtaaggtagatgctgcatccttgggactctcagg

SEQ ID NO: 15596 - RNA, 240 nt, unidentified
  source 1..240: mol_type = other RNA; note = Related to NZ_LMCH01000057.1; note = Pseudovibrio sp.
actgagagcttccaaggtgctatctagtacccaccgctcgaaagggcggtcatgacgattacttacactgatcgtctggggcactggggtttcccagcgccgtcgatggagcgcatgattgcacgtctctgggcaaagaaagcagtcccggagggacacagtcgtatgccttcattgcttcctttgcccaaagcacccgttccgggtgaaagtagatgaagcatccttgggactctcaga

SEQ ID NO: 15597 - RNA, 240 nt, unidentified
  source 1..240: mol_type = other RNA; note = Related to NZ_CP066786.1; note = Martelella lutilitoris
cctgagagcttccaaggtgccatctagtactcaccgttcgaaagagcggtcatgatggttacttacactaatcgtcaagggcactggggtttcccagcgccgtcgatggagcgcatgattgcacgtctctgggcaaagcaagcagtcccggagggacacagtcgtttgccttcattgcttcctttgcccacagcacccgtaccgggtgaaagtagatgaagcatccttgggactctcaaa

SEQ ID NO: 15598 - RNA, 234 nt, unidentified
  source 1..234: mol_type = other RNA; note = Hyphomonadaceae bacterium; note = Related to JAEUMP010000012.1
tctgagggttccgcggaggccacctagcgtacgccgtccttccgggcggccatgacgaccgaccgaagttggttgttagggccttggggcttcccttggccatgtcggagcatctgaagacaggttccgtatcatcatcgcgtccctacgggtccattcgaaggctcataagcgacgatgatgcgcatcctgcgccgggcaaaatgtagatgagccatccgtgggactctcaga

SEQ ID NO: 15599 - RNA, 226 nt, unidentified
  source 1..226: mol_type = other RNA; note = Alphaproteobacteria bacterium; note = Related to VGDE01000018.1
gttgagagttccaagaggcgggtctagcaatgccagtcgttgactggccaagatggggacacctgtcatgggcatctgggtttctgggcgccgctgagagagctgatgaataactgcacctatatgccagtccacgccggaggtacgttcgggagactcaccgtggaccggcatatagcccttcgggccgaactaaagtagacgatgcaagcttggaactctcaac

SEQ ID NO: 15600 - RNA, 247 nt, unidentified
  source 1..247: mol_type = other RNA; note = Related to JXQV01000002.1; note = Agrobacterium tumefaciens
tttgagagaaccaagggtgctcacatctagtgttcgccgctcttcggagcggccaagatgatgcgtccatgcgtatcgtcatgggtggtcgggtttccggccgccgttgaaagagctgatgattgtagtctgttgcctgtcgattccagtcgcaagcgacatcactcggtcaccggctcgtttggaaccgacaggcatcaccccatccggggcggaaggtagatgctgcatccttgggactctcagc

SEQ ID NO: 15601 - RNA, 247 nt, unidentified
  source 1..247: mol_type = other RNA; note = Related to NZ_JAHYCB010000008.1; note = Rhizobium populisoli
tctgagagaaccaagggtgctcgcatctagtgttcgccgctcttcggagcggccaagatgatgtgtgtatgcgcatcgtcgtgggtggccgggtttccggtcgccgttgaaagagctgatgattgtagtctgttgcctgtcgatcccagtcgcaagcgacatcactcggtcaccggctcgtttggaaccgacaggcatcaccccgtccggggcggaaggtagatgcggcacccttgggactctcaga

SEQ ID NO: 15602 - RNA, 258 nt, unidentified
  source 1..258: mol_type = other RNA; note = Related to NZ_LHZT01000085.1; note = Acetobacter tropicalis
gttgagggttccaaccgaggtctagataccggtctcgcaaagcgagaccaccgtcagtggtgggattttccgtcactaccggcttccgggtttcttgttgccgaggaaagagcttccgatcgcaggtcctggtcctgtgcgctcgcccccctttgggggggcgtttcgtagagggggtgtgtcgtatgactcactcgagcccacaggacccgcacatgtgcggagattaaaggtagatgctcagttggaaccctcaac

SEQ ID NO: 15603 - RNA, 217 nt, unidentified
  source 1..217: mol_type = other RNA; note = Related to JAAXBO010000012.1; note = Rhizobium leguminosarum
gttgcgaggttaatagtttgaacgagacgctcgtgctcacgagatcggtgacgggcctatggcctgttgggttaggattgccgaaacccgccggacgagccactgcaaagcctagcggctgtgtgagcgtttctagctcgtggcgaacgccttacggcgaaacgctcacgcaaacgcactgatcggccaaagtcgatgaattatttgacctcgcaac

SEQ ID NO: 15604 - RNA, 214 nt, unidentified
  source 1..214: mol_type = other RNA; note = Related to NZ_CP090091.1; note = Rhizobium leguminosarum
gttgcgaggatgatagtttgaacgagacgctcgtgctcacgagatcgacaggccacgcgcctgttgggttaggattgccgaagcccgtcggacgagccaccgcaaagcctagcggctacgtggacgtttcctgcccgcggcgaatgccttacggtgaaacgcccacgcaaacgcactgatcggctaaagtcgatgaactacataacctcgcaac

SEQ ID NO: 15605 - RNA, 214 nt, unidentified
  source 1..214: mol_type = other RNA; note = Related to NZ_CP092346.1; note = Rhizobium gallicum
gttgcgagggtgatagtttgaacgagacgctcgtgctcacgagatcgacaggcgaggagcctgttgggttaggattgccgaagcccgtcggacgagccactgcaaagcctagcggctgtgtgagcgtttctatatcgtggcgagagccttacgacgaaacgcccacgcaaacgcactgatcggccaaagtcgatgaattatctcacctcgcaac

SEQ ID NO: 15606 - RNA, 229 nt, unidentified
  source 1..229: mol_type = other RNA; note = Related to NZ_CP065229.1; note = Erythrobacter sp.
gctgcggggttaagcaggccacgagagaagctcgtgctcacgagagcgattggacggtcgccgcaaggaaccgttcaattgggttaggattgccgaagccctacggtcgagccaccgcccagccattcggctgggcacgcatcggcttaacgcccgagcgccgggctaccgacgcgtgcccagacgaacccattcgggtcaaagtcgatgtccagtttctctccgcagc

SEQ ID NO: 15607 - RNA, 229 nt, unidentified
  source 1..229: mol_type = other RNA; note = Related to NZ_CP016461.1; note = Blastomonas sp.
gttgcggggttaagcagggccacgagagatgctcgtggtcacgagagcgattggacggtgccgcaaggggccgttcaattgggttaggattgccgaagccctacgatcgagccaccgcccagccattcggctgggcacgcatcgtcttaacgcccgaacgccgggctaacgacgcgtgcccagacgaacccattcgggtcaaagtcgatgcccagtttttccccgcagc

SEQ ID NO: 15608 - RNA, 237 nt, Pseudomonas sp.
  source 1..237: mol_type = other RNA; note = Related to NZ_JACAQV010000005.1; note = Pseudomonas salomonii
gctgagagcgccagactgacgtttctagtgttggtacggcgacgtacccggtatcagatgatgatgcaatgggggacatactttgtccttttcggagtagcatgcgcttaagtgtaagtatcaacccgccttcgcaattgcgaaagtgcatgctcggtcgcaagctcgcctcgcctctcggcgggctgattctcacccttcgggtgtcaaagtagatgtcagtctggcgcgctcagc

SEQ ID NO: 15609 - RNA, 237 nt, Pseudomonas sp.
  source 1..237: mol_type = other RNA; note = Related to NZ_UWGW01000546.1; note = Pseudomonas viridiflava
gctgagagcgccagactgacgtttctagtgttggtacggcgacgtacccggtatcagatgatgatgcaatgggggacatactttgtccttttcggagtagcatgcgcttaagtgtaagcatcaacccgccttcgcaattgcgaaagtgcatgctcggtcgcaagctcgcctcgcctctcggcgggctgattctcacccttcgggtgtcaaagtagatgtcagtctggcgcgctcagc

SEQ ID NO: 15610 - RNA, 231 nt, Pseudomonas sp.
  source 1..231: mol_type = other RNA; note = Related to NZ_CM001559.1; note = Pseudomonas chlororaphis
gctgagagcgccagactgacgtttctagtgttggtacggcaacgtacccggtatcagagatgatgcatttgggggacatattttgtcccttacggagtagcatgcgcttaagtgtaagcatcaacccaccttcgcaaaagcgtatgctcggtcgcaagctcgcctcgcagctcggcgggttgattctcacccttcgggtgtcaaagtagatgtcagtctggcgccctcagc

SEQ ID NO: 15611 - RNA, 227 nt, Pseudomonas sp.
  source 1..227: mol_type = other RNA; note = Related to NZ_UWJA01000102.1; note = Pseudomonas viridiflava
gctgagggcgccggattgattcttctagattggtatggcgacatacccggtatctgatgatgcataggaggacatattttgtcctttacggagtagcatgcgcttaaagtgtaagcatcaacgcaccttcgcccataggccactcggtcgcaggctcgcctcgctgctcggcgcgctgattctcacccttcgggtgtcaaagtagatgacagtttggcgtcctcagc

SEQ ID NO: 15612 - RNA, 236 nt, Pseudomonas sp.
  source 1..236: mol_type = other RNA; note = Related to NZ_CP077076.1; note = Pseudomonas fakonensis
gctgaggtagccagattgttccatctagaatggcgtggtgacacgcccggtatcaactgatgatgatgctattgaggacatattttgtccttttcggagtagcgtgcgcataagtgtaagcatcagcgcaccttcgcccactgagggcccctcggtcgcaagctcgcctcgatgctcaggcgcgctgtttctcaccctgcgggtgtcaaagtagatggcaatctggcgacctcagc

SEQ ID NO: 15613 - RNA, 229 nt, Pseudomonas sp.
  source 1..229: mol_type = other RNA; note = Related to NZ_FOTU01000001.1; note = Pseudomonas syringae
gttgaggtagccagattgatctatctagcatggcatggtgacatgcccggtatcagtgatgatgctatggaggacatattttgtccttttcggagtagcgtgcgcttaagtgtaagcatcagcgcaccttcgcccacaggccactcggtcgcaggctcgcctcgttgctcaggcgcgctgtttctcacccttcgggtgtcaaagtagatggcaatctggcgtcctcaac

SEQ ID NO: 15614 - RNA, 229 nt, Pseudomonas sp.
  source 1..229: mol_type = other RNA; note = Related to NZ_UUET01000191.1; note = Pseudomonas viridiflava
gctgaggatgccagactgacctatctagaattgcacggtgacgtgcacggtatcatcgatgattctacggggggcatattttgtccttttcggagtagcttgcgcttaaagtgtaagcagcagcgcaccttcgaccgcaggccactcggtcgcaagctcgcctcgtttctcggcgcgctgcttctcacccttcgggtgtcaaagtagatggtggtctggcgttctcagc

SEQ ID NO: 15615 - RNA, 230 nt, unidentified
  source 1..230: mol_type = other RNA; note = Related to NZ_LPFA01000028.1; note = Burkholderia cepacia
gctgagggcgtcggattagccatctagtgatggcatggcaacatgcccggcgactgcccttcggggcggccatgggacacatattttgtgctccttcgacgcagcaggcgcaaacgtgtaagcatcgtcgcgatccgctacgctgtgtacctctgcgctcgtcttgctgcgaaccgcgacgatcctcacccttcgggtgtcaaagtagatggctatctggcgcgctcagc

SEQ ID NO: 15616 - RNA, 221 nt, unidentified
  source 1..221: mol_type = other RNA; note = Related to PBYJ01000011.1; note = Oceanospirillaceae bacterium
gctgaaggcgccagtgagctccatctagcattgcatggaaacatgcacaaaggctgttgatgtaagaacagtcggggacgcatattttgcgatcctttgatgtagcagacgctaatgtgtaagcatggtcgcgattcggcggccgctacgaggtcttgctgcgaaccgcgaccatcctcaccccaaggggtcaaagtagatgaatcactggcgccctcagc

SEQ ID NO: 15617 - RNA, 240 nt, Escherichia coli
  source 1..240: mol_type = other RNA; note = Related to CP059835.1
gttgaggaggccataatgtttcatttagcgttaacacaagtaactaccattacttgtcaggagaagtgtatacctttcctgcgggccatatattttatgtgctcatgtattagcactcgcaatagtgtaagcaaaatcacgacgatcccgacttcgtcggctcgatcgtggtctttcttatcgccgcgattttacttaccccttcggggtcaaagtaaatgaaacaatggtctcctcagc

SEQ ID NO: 15618 - RNA, 240 nt, unidentified
  source 1..240: mol_type = other RNA; note = Related to NZ_CP011118.1; note = Yersinia enterocolitica
gttgaggaggccataatgtttcatttagcgataacacaagtaacttgcattacttgtcagaagaagcatatgcctctcctgcgggccatatattttatgtgctcatgtattagcactcgcaatggcgtaagcaaaatcacgacgatcccgacttcgtcggttcgatcgcggtctttcttatcgtcgcgattttacttacccctccggggccaaagtaaatgaaacaatggtctcctcagc

SEQ ID NO: 15619 - RNA, 243 nt, Acinetobacter sp.
  source 1..243: mol_type = other RNA; note = Related to CP018254.1; note = Acinetobacter baumannii
gttgaggagaccataatgtttcatttagcgttcgctcaagtaactattacagttacttgtctgattagttttaaactcaatcagtcggctatattctatataagcccaagtaatagctctcgcaaaagagtaaccaagatcacgacaatagcgactaaagtcgctcgattgtgtcctcacttattgtcgcgatcttacttacccctccggggccaaagtaaatgaaatcatggtctcctcagc

SEQ ID NO: 15620 - RNA, 246 nt, unidentified
  source 1..246: mol_type = other RNA; note = Related to NZ_PUJU01000037.1; note = Photorhabdus tasmaniensis
gttgagaggaccatcataatgttttatttagcgtcttcacaagtgacaccattcacttgtccagtaactacaaagtgtaaactgggggccgtatactttacgtgctcatggaatagctctcgcattagtgtaagcgggatcgacgcaataccgacgatgtcgggtgaaacgcagacttatctattgcgccgatccccctcaccccttcggggccaaagtaaatgagacaacggtggtcccctcaac

SEQ ID NO: 15621 - RNA, 209 nt, Vibrio sp.
  source 1..209: mol_type = other RNA; note = Related to NZ_CP073273.1; note = Vibrio fluvialis
gctgagggcgtcagattagatctagcgttgtaaacttaaacagtttacggggaagcatattttgcaaccttcggagcagcagaggcaaagtggagcgttgaggcatttacttcgcggccactcgtagactcgttgcgaataaaatacctcaatgctccctatcaagagcgaaaagtagaagtagatgaataatatttggcgtcctcagt

SEQ ID NO: 15622 - RNA, 212 nt, unidentified
  source 1..212: mol_type = other RNA; note = Related to JACFTX010000002.1; note = Photobacterium damselae
tctgagggagccatattaaatctagcattcgtaaaccactatatttatggtttactgggaagcatattttgcaaccttaggaaaagcaggggctatcgtggagcgttgtgtgatttttttcgcatttgctcgtagcctcgccctcaaaaatcacataaagctccagatcaagagcgaaaagtaagagtagatgaataattggcgccctcagc

SEQ ID NO: 15623 - RNA, 325 nt, unidentified
  source 1..325: mol_type = other RNA; note = Related to NZ_KE383828.1; note = Oceanospirillum beijerinckii
gctgagggttccagtttgagttttctagcattagtgccaacaggcatctaagtagtcatacaaaagtttttcggcactattgtctctacccttataaaccaccggatggtgaaggtggaaaacttatgtaagactgcttattaagtgatcaaggatgtttgcttagtttaatggtcgcatattttgcgtaccttagtaatagcagacgcatagtgtcagtatagtcgcgattcaacggtctctcgtgcttcgcgcctcaatgctgaaccgcgactattctaacccaagggttaaaagtagatgtacaaaaactggaatcctcagc

SEQ ID NO: 15624 - RNA, 208 nt, unidentified
  source 1..208: mol_type = other RNA; note = Related to NZ_CH672406.1; note = Idiomarina baltica
tttgggagctcctctctattaatctagcgaatacaggctgttagcctgtcaattttgaggagcatgttgttttctcattgagcgagccgccgcttagagtctaagtgagactcacagccacctaaaggctgtggtcgtcgactctctgctgcgagtctcatttaccctccttacggataaaagtagatgaatagatggagctcccgag

SEQ ID NO: 15625 - RNA, 260 nt, unidentified
  source 1..260: mol_type = other RNA; note = Related to NZ_AKKU01000003.1; note = Alishewanella agri
actgagagctctaaatggagtttagcttgaaccaatgtaaaatgcattcgtctgtagaccaatgtgttaagcatttctctcataattttattatgagtagaggggagtcagagtctgtcctccttggaaatagcatccgattgatgctaagcatgaccacgcaattccgactgcgtcggatggcgtcgaggccttgcctaatcgcgcggtcctcctcaccctgcgggtgtcgaagtaaatgaacagatggagctctcagt

SEQ ID NO: 15626 - RNA, 219 nt, unidentified
  source 1..219: mol_type = other RNA; note = Related to NZ_LCTG01000001.1; note = Gluconobacter oxydans
attgagagtctcgtgagggtatttagctcctgcgcaagcaggcgtgatgctgggcatccctgtccggtgttaccggcgtttgtatttcgagcgctgccgaatgagcctccgcataggccttatcgctcgtcctccgcttgggctgcgatgggcttgctgcggagtacgaacgacaagtccatggtcctagagggtaaatgactttgtgggactctcaag

SEQ ID NO: 15627 - RNA, 220 nt, unidentified
  source 1..220: mol_type = other RNA; note = Related to NZ_JSXI01000043.1; note = Sphingomonas sp.
gctgagagtctcatgaggacgtttagttcctgcgaaagcaggcgtgatgccgggcatccctgtccggcgtcaccggcgaccgtatttcggtcgctgacgagcgagcctccgcataggccttatcggtcacgctccgctcggggctgcgataggcttgccgcggagcgcgaccgaccagtccatgatcctagagggtagatgaccttgtgggactctcaaa

SEQ ID NO: 15628 - RNA, 236 nt, unidentified
  source 1..236: mol_type = other RNA; note = Alphaproteobacteria bacterium; note = Related to JAFKFG010000027.1
gctgaggattccttgatttgtaactagcacccttcccaaccgaaaggcggaagggcagtgttgggtggcatccctgtcatcctactgtggcgcttgtgtttcgggcgctttctgattgagcgtaagcaaaaagccttgtttgtcttcgctagactcgcatcgcacggctcgcggtcgagcgaagacaatcaacgccatgaacagacgaaggtagatgcaaaattggaattctcagc

SEQ ID NO: 15629 - RNA, 232 nt, unidentified
  source 1..232: mol_type = other RNA; note = Related to JABMRO010000623.1; note = Planctomycetes bacterium
attaaggaactcagcgagttcatttagttcaggttccctgggaagggaactaccatgactataggcttatcgcttattgttatggggaaactggattaccagttttctcggttaaagcgtgcgcatgtcactaaggttgtgcacgctacggctttctctacgtgcggcttgaggcgcagcgtgcacagcctcacttcgtggaggtcaaagtaaatgaatcgctgggttccac

SEQ ID NO: 15630 - RNA, 237 nt, unidentified
  source 1..237: mol_type = other RNA; note = Related to NZ_FNIN01000001.1; note = Desulfonauticus submarinus
attgaggggattaactgctttatctagtaaaactacctctttggaaaatggaggtagaaatgactgttaatttaacggtctggggatttggattaccaaatctctgtagaaaagcgggtgcttgcggactaaggcatgatgttgtgccgccttcggccgctcgatgtctcgctttgtcacaacatcatatcttacctctcaggaggtcaaagtagatgaagcgttggtcccctcatt

SEQ ID NO: 15631 - RNA, 264 nt, unidentified
  source 1..264: mol_type = other RNA; note = Related to JAGRCJ010000081.1; note = Caldilineaceae bacterium
gaggagtgttcgatagcaattttatctagtgtatgtcgacggcctttgccatcgaccccgtaaaaccgtgctgatttactagcctggtttggacaacaaaatattgttgtcttggtgaaagctcaggtttgtgctaaggcttgcgcgcactgcttcttccagcgatgtctcggcgcagtacgcgcattcctcgcatttgctggttaaaagatttagcaatatgcgatcaaaggaagtagataaatatgtcaatcggacctcctc

SEQ ID NO: 15632 - RNA, 209 nt, unidentified
  source 1..209: mol_type = other RNA; note = Related to VTRK01000013.1; note = Comamonas thiooxydans
gttgagggaccgcaacgttggttagcgtttacctaggccattgttttcagcggcattggttggggcgcggatttcagctgccctttgaactagcccacgctttggcggatgcaagaggcgactctttcatccgtcgatgcctcgggtcagactcgcctctcccctccgccctgcggagtcaaagtagctaatgatgtggtcctctcaac

SEQ ID NO: 15633 - RNA, 209 nt, unidentified
  source 1..209: mol_type = other RNA; note = Related to NZ_CP049990.1; note = Pusillimonas sp.
gttgagggaccgcagtgttggttagcgtttaccttggcctatgttttcagcggcatgggttggggcgcggattgccgctgccctctggaatagcccaagctttggcggatgttagaggcgactcttccatccttcggagcctcgggtcagactcgcctctcacttccgctctgcgtaattgaagtagctgacaatgtggtcttctcaac

SEQ ID NO: 15634 - RNA, 212 nt, unidentified
  source 1..212: mol_type = other RNA; note = Related to JAKZFD010000012.1; note = Pelomonas sp.
gttgagagggcgcaccgttggctagcgttgacctggacctgtgttttcagcggcacaggttggggcgcggatttccgttgccctctgaagttgcccaggctatggcggatgcaagacgcgagtcatccatcctacgaagcctcgggtcagactcgcgtctcccctccgccggtcgtcggagtaaaagtagctaacgatgtggtcctctcaac

SEQ ID NO: 15635 - RNA, 212 nt, unidentified
  source 1..212: mol_type = other RNA; note = Related to NZ_CP028294.1; note = Acidovorax avenae
gttgaggggccgcattgctggctagcgttgacctaggcctgtgttttaagcggcactggttggggctcggaattccgcagctctatgaaattgcccaagctttggcggatgtaagacgcgagtgcttcatccttcggagtctcgggtcagactcgcgtctctcctccgcctgtcgtcggagtaaaagtagctagcaatgtggtcctctcaac

SEQ ID NO: 15636 - RNA, 234 nt, unidentified
  source 1..234: mol_type = other RNA; note = Related to JACEZU010000002.1; note = Duganella sp.
gttgaggagccacagcgagagttagtgtttaccacgtgccataccttcgggtgcaggcatgtacctttgccttcgggtttagggtggtggcggattccgcttcccattgaagtagcctacgcattgacggatgcgtagcacgactatccccgcgtcgcggactccgggttttagccgcgctacgcacccccgtacaaaacttaacgagagtaatcttaatgtggtctcctcgac

SEQ ID NO: 15637 - RNA, 204 nt, unidentified
  source 1..204: mol_type = other RNA; note = Related to NZ_JACHHM010000011.1; note = Parapusillimonas granuli
gttgaagagccacggcaatggttagtgcttacctagacctgtgttttcggcattggttgggacgcggatttccgccgtcctctgatccagctctcgcactggcgaaattacacaccagtcctcctatccttcggggcctcgggtccgactggcgtgtacctccgcaagcggagtcgaagtagcttatgccgtggtctcctcaac

SEQ ID NO: 15638 - RNA, 203 nt, unidentified
  source 1..203: mol_type = other RNA; note = Related to SEEN01000026.1; note = Hyphomicrobiales bacterium
gttgagggaccacggtcatggttagtgcttacctagacccgtgtttacggcattggttgggacgcggatttccgccgttctttgatccagctctcgcactggcgaaattacgcaccagtcctcccatccttcggggcctcggggctgactggcgcgtacctccgcaagcggagtcgaagtaactatgctgtggtctcctcaac

SEQ ID NO: 15639 - RNA, 221 nt, Pseudomonas sp.
  source 1..221: mol_type = other RNA; note = Related to RKKU01000049.1; note = Pseudomonas neustonica
gttgagaagatcacgttgaaggttagtgttcaccggagcaaccggagcgagcttgactcgtccattgctgctgtgggggcgcggagttccgctgcctttcgtagaagctttcgcaaggcggatgtcgagcacgactcaaccaacctgcggaagacttggggtggagccgcgctcggcttccactttcgtgtcaaagtagcctgacatgtggtcttctcaac

SEQ ID NO: 15640 - RNA, 230 nt, Pseudomonas sp.; identical to SEQ ID NO: 15499
  source 1..230: mol_type = other RNA; note = Related to NZ_CP018420.1; note = Pseudomonas veronii

SEQ ID NO: 15641 - RNA, 221 nt, unidentified
  source 1..221: mol_type = other RNA; note = Hydrogenophilales bacterium CG_4_10_14_3_um_filter_58_23; note = Related to PFJY01000128.1
gttgagaagccaccttgttagttagtgtttaccggagcatgttgatcaggcctagcttgtatagcttgcttttgttggggtgcggagttccgctacccttcgtagaagcctacgcattgcggatgttgagcacgactcaactctcctgcggaggacttggggctgagccgtgctcagcgtccacagtcgtgtcgaagtaactgatatgtggtcttctcaac

SEQ ID NO: 15642 - RNA, 252 nt, unidentified
  source 1..252: mol_type = other RNA; note = Related to CP021181.1; note = Rhizorhabdus wittichii
gttgagggctcctgtggagtcgcatagttgacgtcgccgcatcggctttgctggtgtttcgacggcaacatatggtcttcgggtcatatgtttcggggcgcagaatctgctgctctcaggacaagcctccgctcgatgctaaggcatatcgcgcaacgccgcttacagcggatcgcgtcggtgtctagctacgtcgcgcgatatgtctcacccccagggtgtcaaagtacgtgacttcttggagccctcaac

SEQ ID NO: 15643 - RNA, 221 nt, unidentified
  source 1..221: mol_type = other RNA; note = Related to SECT01000232.1; note = Oxalobacteraceae bacterium
gttgagggggccagatcgaggctagtgcgtgcccgggagggtacatagacgcttgcacaacaggcttgcgttgggacgcggattgccgttgttctgagaagaagccggcgcttgacaggaggttgcatacgacttccatttacgagcgcttgtctcctagaaagccgcatgcatccgcctgcggcggatatcgaagtagtcctcaatgtggtctcctcaac

SEQ ID NO: 15644 - RNA, 221 nt, unidentified
  source 1..221: mol_type = other RNA; note = Related to NGUN01000003.1; note = Sphingobium sp.
gttgaggggaccaccttgaggctagtgcgcgtccatttggacgcatagacacttgctcaacaggcttgtgtcggggcgcggatttcagttgccctaagaataagccggcgcttgacaggaggttgcatgcgaccttctttcacgagcgcttgtctcctagaaggccgcatgcatccgcctgcggcggatatcgaagtagtcctgaatgtggtctcctcaac

SEQ ID NO: 15645 - RNA, 221 nt, unidentified
  source 1..221: mol_type = other RNA; note = Related to QFNB01000026.1; note = Pelagerythrobacter marensis
gttgagggggccatcttgaggctagtgcgcgtccgcgaggacgtattaacgcttgctcaactggcttgcgttggggcgcggattaccgttgctctaagaaaaagcttgcgcttgacaggaggttgcatgcgacttccctttacgagcgcacgcctcctagaaagccgcatgcatccgcctgcggcggatatcaaagtagtcctcgatgtggtctcctcaac

SEQ ID NO: 15646 - RNA, 219 nt, unidentified
  source 1..219: mol_type = other RNA; note = Related to JAEMRT010000003.1; note = Sphingopyxis sp.
gttgagggggccaccttgaggctagtgcgcgtccgcaagggcgcatagacgctgctcaaacggctgcgttggggctcggaattccgttgctctcagatcaagcccgcgcgtgacaggaggttgcatacgacttcccttcacgagcgcaagtctcctagaaagccgcatgcatccgcctgcggcggacaccgaagtagtcctttatgtggtctcctcaac

SEQ ID NO: 15647 - RNA, 220 nt, unidentified
  source 1..220: mol_type = other RNA; note = Related to NZ_JACRVS010000011.1; note = Acetobacter sp.
gttgaggggcccaccgggaggctagtgcgcgtccgcaaggacgcattgacgtatgctcaacggcatgcgttggggcgcggatttccgctgccctcagaacaagtccgcgcttgacaggaggttgcatgcgacctctctaatcgagcgcatgtctccggataggccgcatgcatccgcctgcggcggatatcaaagtagtcctctatgtggtctcctcaac

SEQ ID NO: 15648 - RNA, 225 nt, unidentified
  source 1..225: mol_type = other RNA; note = Related to NZ_SCNH01000027.1; note = Sphingomonas sp.
gttgggggggccacatggaggctagtgcgcgccgtctcatttggcggtgcatagacgggtatccagctgtatccgttggggcgcggattaccgttgctcttagaacaagtccacgcttggcaggaggttgcgtacggcttctccgcgagcgtgagccttcgggttcagccgcacgcatccgcctgcggcggagatcaaagtagtcctccatgtggtctcctcaac

SEQ ID NO: 15649 - RNA, 224 nt, unidentified
  source 1..224: mol_type = other RNA; note = Related to NZ_CP013949.1; note = Bradyrhizobium sp.
gttgagaggatcggggcatggttagtgcgtgcctgacgcaggtcaggcacctaggcagttgtaagctgtaactgctggggctcggactaccgcagccctgtgagcaagctgacgctaggcagtcgattaaagggaaagcctgtttcccatcgtgcgcctcgcgtcggctctccctttattcacctacggtgaagtcaaagtaactatgtcttggtcttctcaac

SEQ ID NO: 15650 - RNA, 221 nt, unidentified
  source 1..221: mol_type = other RNA; note = Related to CP090554.1; note = Neorhizobium galegae
gttgaggagacccgctcatggttagtgcgggccatctgaagaggtggtccatagacggctattactgtagtcgttggggcgcggattaccgctgctctaagaacaagcctaggcttgacaggaggtcgcgaacgcctcttttctccatcgcgcgcctcggggcgagccgtccgcggccgcctgcggcggcatcgaagtagctatggcgtggtcttctcaac

SEQ ID NO: 15651 - RNA, 242 nt, Citrobacter sp.
  source 1..242: mol_type = other RNA; note = Related to DACSWP010000009.1; note = Citrobacter freundii
actgagaaggactacatatgactagtgtcagcaagcaactctccatcttacctattggcttgattgagaattgctacatcattttgatgttggggtagggacttcctgagccttatgaaatagccctcgcttggctggagacggcgcactctgccttttccagcgtaagccttgggtcaccagagcgcgccgtcgcctgcggcgacatacgcatcggagtagttgtatgtggtcctctcata

SEQ ID NO: 15652 - RNA, 244 nt, unidentified
  source 1..244: mol_type = other RNA; note = Related to CP068391.1; note = Serratia proteamaculans
actgagagcgactacgtatgactagtgctaacgagcaatacaaagtcacccccttggggatgatagagggttgctacaccactttacagtgggtgttggggtatggatttcctgaacctcacgaaaaagcccacgcttggctggagacggcgcactctgcctccgccagcgtaagtcttgggttaccagagcgcgccgtcgcctgcggcgacgcatcggagtagttatatgtggtcctctcaat

SEQ ID NO: 15653 - RNA, 244 nt, Aeromonas sp.
  source 1..244: mol_type = other RNA; note = Related to NKWH01000001.1; note = Aeromonas veronii
actgagagagaccacatatgactagtgttaacgagcaacacaaagcctttccaatcggatcggtggaggtttgctacaccactttacagtggatgttggggtacggatttcctgagcctcatgaaaaagccctcgcttggctggagacggcgcactctgcctctaccagcgtgagccttgggtcaccagagcgcgccgtcgcctgcggcgacgcatcggagtagttttatgtggtcctctcaaa

SEQ ID NO: 15654 - RNA, 243 nt, unidentified
  source 1..243: mol_type = other RNA; note = Related to CP022196.1; note = Celeribacter ethanolicus
gttgagagcggtcacctatgactagtgctagcgagcgattcaaattcgcaccctcgggggcgaaggaggatcgctacaccactgtaaggtggatgttggggtacggattccggggcctcacggaaaagcccacgcatggctggagacggcgcactctgcctcatccagcgtatgcctcgggtcaccagagcgcgccgtcgcctgcggcgacgcatcggagtagttttatgtggtcctctcaat

SEQ ID NO: 15655 - RNA, 244 nt, unidentified
  source 1..244: mol_type = other RNA; note = Related to JAIUZF010000015.1; note = Salipiger thiooxidans
gttgagagagaccacctatgactagtgctagcgagcaatgcaaagtcgcaccttcgggggcgagggaggattgctacaccactgtaaggtggatgttggggtacggagttccggagcctcacgacaaagcccacgcatggctggagacggcgcactctgcctcttccatcgtatgcctcgggtcaccagagcgcgccgccgcctgcggcgacgcatcggagtagttttatgtggtcctctcaat

SEQ ID NO: 15656 - RNA, 248 nt, unidentified
  source 1..248: mol_type = other RNA; note = Related to JAHVJB010000004.1; note = Mameliella alba
cctgagagcgactgctatttgactagtgttagccggcagcaggaaacccgtccttacggtgggtagattgctgacatgctcatcctcacggttgagctttgggatagggattgcccgattctcacggccaagcctacgcatgattggagacggcacactctgcctcttccttcggctgtctctgggtcgccagagtgtgccgtcgcctgcggcgacgcatcggagtagttaaatgtggtcctctcaca

SEQ ID NO: 15657 - RNA, 222 nt, unidentified
  source 1..222: mol_type = other RNA; note = Rhodobacterales bacterium; note = Related to VIRH01000027.1
gttgagaggagccgcaattgattagtgttcgcaagcagttagtgtctattagctgcggcaactgcggttgttggggtaaggagttcctgatcctcatggaaaaactcatgcattactggaggcggagcacttcgacatttgtccggtgcgtgtgccttcggtgtcgaagcgctccgccgcctgcggcggcgtgacggagtaattgaatgtggctccctcaaa

SEQ ID NO: 15658 - RNA, 221 nt, unidentified
  source 1..221: mol_type = other RNA; note = Related to JAAXTE010000009.1; note = Rhizobium laguerreae
actgagaccgaccacatgttgattagtgttagcaagcaacgtcagttgtttacggttgccgcaaggcaaccgtcggggcaaggatttcctgtacctcgtgagaaagctcaggctgggctggagacgaagcactctgcaagtctcctacgtatgccttgggcagcagagcgcttcgtcgcctgcggcgacgcatcggagtaacagcatgtggtcgtctcacc

SEQ ID NO: 15659 - RNA, 221 nt, unidentified
  source 1..221: mol_type = other RNA; note = Related to AHZC01000134.1; note = Rhizobium sp.
gttgagaccgaccacatgttgattagtgttagcaagcaacgtcagttgcttacggttgccgcaaggcaaccgtcggggcaaggatttcctgcacctcgtgataaagctcaggcttggctggagacgaagcactctgcaagtctcctgcgtgtgccttgggcagcagagcgcttcgtcgcctgcggcgacgcatcggagtaacagcatgtggtcgtctcacc

SEQ ID NO: 15660 - RNA, 221 nt, unidentified
  source 1..221: mol_type = other RNA; note = Related to WIDU01000012.1; note = Rhizobium leguminosarum
gctgagacagatcacatgctgattagtgttagcaagcaacgtcagttgcttaccgccgtcttagggcggcggttggggcaaggatttcctgcacctcgtgagaaagctcaggcttggctggagacgaagcactctgcaagactccagcgtatgccttgggcagcagagcgcttcgtcgcccgcggcgacgcatcggagtaacagtatgtggtcgtctcacc

SEQ ID NO: 15661 - RNA, 231 nt, unidentified
  source 1..231: mol_type = other RNA; note = Related to PAYC01000024.1; note = Idiomarinaceae bacterium
tctgaggaagaccatataatgattagtgtagcgagcaggatatactctgtgtattctgctaccacagaagtaaatcattgtggtgggaggcgggagttcccgtcctctttggaaaagcccttgctgagcgagagcacagtcactctggcaatgttccctcgctggctcgggttgccagagcgactgtacgctctggtttaatcggagtaattgttatgtggtctcctcttt

SEQ ID NO: 15662 - RNA, 226 nt, unidentified
  source 1..226: mol_type = other RNA; note = Related to JXYC01000005.1; note = Marinomonas sp.
attgagagaggctgcatatgattagtgatagcaagcaacttactctaagttgctgtagttactttagtggtgactactggggtatggatttcctgatcctcatggaaaagcttacgcttggctggagggtgaatactctgccgtatacccacgtaagcctaaggccgccagagcactcatccgcctgcggcggtgtttcggagtaattatatgtggtctcctcaac

SEQ ID NO: 15663 - RNA, 223 nt, unidentified
  source 1..223: mol_type = other RNA; note = Endozoicomonadaceae bacterium; note = Related to JAAOIO010000006.1
attgagagaggctacatatgattagtgttaacacgcaactgaaaggttgcgatagttatttaataagtaactgttggggtaaggatttcctgaacctcatggaaaagcctacgcttgactggaaatggagtactctgcttccgccgcgtatgcctaaggtcagcagagcactccatcgcctgcggcgatgtatcagagtaatcgtatatgtggtctcctcaat

SEQ ID NO: 15664 - RNA, 223 nt, Vibrio parahaemolyticus
  source 1..223: mol_type = other RNA; note = Related to CP006008.1
actgagagagaccactaatgattagtgtttacaagcaactaacaagttgcggtacttttactatgtatgagtactggggtaaggatttcctgaacctcaaggaaaagcggacgcttgactggagacggagcactctgccttctgcccgcgtacgccttaggtcgccagagcgctccgtcgcctgcggcgacgatttggagtaatcgtatgtggtctcctcata

SEQ ID NO: 15665 - RNA, 221 nt, unidentified
  source 1..221: mol_type = other RNA; note = Rhodobacteraceae bacterium WD3A24; note = Related to PUHN01000047.1
gttgaggagggccgcacgtggctagtgtcagcaggcaactttgttgccgcagacgccactatggcggctgtcggggcgtggagtaccatggccctgtggaaaagcctacgcgagactggagattgcgcacgctgcctccttccgtcgtgggcctcgggtcgccagcgcgcgcagtcgccgtgccggcgccatcggagtagtccacgtgtggtcccctcatc

SEQ ID NO: 15666 - RNA, 203 nt, unidentified
  source 1..203: mol_type = other RNA; note = Related to NZ_CDRJ01000001.1; note = Ralstonia solanacearum
gctgagaagtaccgtctatagttagtgcaccaccgaaaccttcggggttcggtggcagtagagcccggattgccgcggtctcattggaatagcttgcgctgtaagggaagttcgaacaacttctccaagcatcgcaagcctcaggtcgaagtcgttcgaattacgccttaggggcgtcaaagtagctatgtggtcttctcagc

SEQ ID NO: 15667 - RNA, 199 nt, unidentified
  source 1..199: mol_type = other RNA; note = Related to NC_017559.1; note = Ralstonia solanacearum
gttgagaggcgtcactgacggttagtgtatcgccgaactgagttcggtgacttttagggtacggattgccgtttcccgcaggaagagctcatgcatgacaggaggcgagaagcgacttctctgccatcgcatgtctcgggtcgaagtcgcttctccccgcccgcttgggcgtcaaagtagcttatgtgggcctctcaac

SEQ ID NO: 15668 - RNA, 235 nt, unidentified
  source 1..235: mol_type = other RNA; note = Related to JADFZH010000217.1; note = Magnetococcales bacterium
gtgaaggggaacttcgggaacttggcaaaactgatcggagtaatggccggtcggtacccatggagacgcagtgatgtggttccatgaacggggagcggagtccgcagtcctggagacagcttatttgggtttgagtatgggtggtcgaccgtctttcgtttcgagcctcactgactggccgaccacccaccctgcgcagcggggttaaagcaagacaatggagtttccccttcac

SEQ ID NO: 15669 - RNA, 242 nt, unidentified
  source 1..242: mol_type = other RNA; note = Related to JADGBU010000012.1; note = Magnetococcales bacterium
gtgaagggaggcttcgttgaacttggcaaaaccgaccggggtcatggccggacggtaccatccagggataagcagcaatgcggatccctggtcggggctcggagtccgatgtcctggaaattgctttcttgagcttgagttggctgatcgaccaccctacgctttgcggcgtactcgcggtttggccgatcagccatcccgcgtagcgggttgaagcaagagatatggagttctcccttcac

SEQ ID NO: 15670 - RNA, 234 nt, unidentified
  source 1..234: mol_type = other RNA; note = Related to KN323041.1; note = Burkholderia pseudomallei
tgtgaaggggtgcttcgttgacttggcaaaactgaccggaggtaatggccagtcagtacccatgtcgtctcttcgagacgcatgaacggggctcggagtccgcagtcctggatacagcattcttgagcgcgagatgggtggacgaccagcttgagcttcgcggtctcgcgatcaggccgtccagccaccacgcagagcgggttaaagcaagaaatatgaagttctcccttcacg

SEQ ID NO: 15671 - RNA, 229 nt, unidentified
  source 1..229: mol_type = other RNA; note = Related to NZ_CP050013.1; note = Serratia marcescens
tgtgaagggaagattcgttaacttggtatcgctggctgcggccagtacccatggagtcactataatgtggaatcatgaacggggcgcggagtccgtcgtcctggaaatagctttcttaaaagcgagatgggaaatcgaccaacttgggttttgcttgtgtctcacgggtcgttcgatttcccaccccgcgatgcggggttgaagcaaggtatgaacttttcccttcact

SEQ ID NO: 15672 - RNA, 232 nt, unidentified
  source 1..232: mol_type = other RNA; note = Related to JAFKLC010000111.1; note = Rhodospirillales bacterium
gtggaggggagatttttgagcctggcaagactgtctgggtaaaatcaggcagtacctgatggggtgccatttggcatctctgcagacggggcgcggagtccgctgtcctggagaaagctactttgtgcgcgagatgggcgatcaagctgcctacgctttgctggtttctcgctaccagctcgatcgaccaccccgcagacggggttaaagcaggatgaacttccccctccac

SEQ ID NO: 15673 - RNA, 234 nt, unidentified
  source 1..234: mol_type = other RNA; note = Betaproteobacteria bacterium; note = Related to RFVU01000153.1
atgggggaacttcacgcgacttggcaaaaccggtcgaggtcatgggcgaccggtacccttgcggctgcgttgcagcggtcgcatgaacggggcgcggagtccgctgccctggaatgtgctgtctcgagcatgagatggtccatcgactgccgcaggcagcgccttgtgcgcagcaccccggtcgatggcccgccccgcccgcggggctgaagcaagccgatggagttcccccgc

SEQ ID NO: 15674 - RNA, 264 nt, Acinetobacter sp.
  source 1..264: mol_type = other RNA; note = Related to NZ_KB894370.1; note = Acinetobacter tjernbergiae
aatgtgatggacattttcgatttctggtagactgttgataaaatacttgattagtagttatcaactgtacagctataacttgattgtagtagttgttcggagctcagagtctgaagctctatgaaatagcttaattttaggcgatgattagccatttccgtattcgctcgttctgctctgctttctggcggcgcagcttcactctacgtaaacggctaaacccgccaaggcgggttaaagcagaggtcaaaatgtccacacaca

SEQ ID NO: 15675 - RNA, 267 nt, Acinetobacter sp.
  source 1..267: mol_type = other RNA; note = Related to NZ_NIWI01000032.1; note = Acinetobacter baumannii
aatgtgatggacattttcggtttctggtagactgttgatacctgttttataagtaggtatcgattgtacaacaaccacaatttgtttgtagttgtatgttgggagctcagagtctgaagctctttgaaatagcttaattttaggcgatgattagccattgtcgtattcgctcgttctgctctgcctgattgcggcgcagcatcactctacgtcaacggctaaacccgccatgcgggttaaagcagaggttgaaaatgtccacacata

SEQ ID NO: 15676 - RNA, 257 nt, Acinetobacter sp.
  source 1..257: mol_type = other RNA; note = Related to KB849902.1; note = Acinetobacter baumannii
tgtgatggacatccacaatttctggtagacgattgttcttaatatttaggagcagttgtacaggtactatttacttagtatctaacgggactcagagtctgacgtcctttgaaatagctatatttttggcgaagattagctattgattcttttcgctcgtactgtagtcgcctctgggggctcacagcttcgcgaaccatcaatagctaaacccgccgtcgcgggttaaagcagaggatttggtatgtccaatcaca

SEQ ID NO: 15677 - RNA, 236 nt, unidentified
  source 1..236: mol_type = other RNA; note = Related to NZ_CP034547.1; note = Burkholderia cenocepacia
gtggaggggtggccaagcatcagtcaaacgtggctacctaacttggtagttgcggccttgttgcgctgataggccaacaatgcggcatcgggagtcccggtgcctcggaagtagctttctcttgatcgaggttaacacgcggttcagagcttcgaaacagcgcctatacctctgaaccgtgtgttgaccccgctccgcggggcgggattaaagtgatgcttggcccttctctccac

SEQ ID NO: 15678 - RNA, 236 nt, unidentified
  source 1..236: mol_type = other RNA; note = Related to NZ_BBQM01000001.1; note = Cupriavidus basilensis
gtggaggggtgaccaagcatcagtcaaacgtggctacctaatttggtagttgcgaccttgttgcgctggaaggccaacaatgcggcatcgggagtcctgatgccttggaagtagctctctcttgatcgaggttaacacgcggttcagagcttcgaaacagcgcctatacctctgagccgtgtgttgaccccgcttcgcggggcgggattaaagtgatgcttggcccttctctccac

SEQ ID NO: 15679 - RNA, 189 nt, unidentified
  source 1..189: mol_type = other RNA; note = Related to NC_018020.1; note = Turneriella parva
gatggggttcagaggacttctggcaagaactcttagagtcaatttggaagtggatttccacaaccgctgaagtagcttatgattacatcaagcaccagtgtcccttttctcgcacggagccttacggaaaagcgacactggtcctcgctggcgcgaggttgaagcagatgttactctggaccccacatc

SEQ ID NO: 15680 - RNA, 271 nt, unidentified
  source 1..271: mol_type = other RNA; note = Related to NZ_CP028271.1; note = Mixta intestinalis
tttggggttccgtcgtgaaacttagttgtggtagatacatatatagtgtatcaactgccattggcagcctacgattccgtttgaatggtttgataggatgccaacgagcacggattccgtcgctctttgtagtagccttcgccagagtgagtagtgatgtgcacgtttgcgcgcgttcttttgctctgggggcaacgaagcctgtgcgcaaacgcgcgcatcacgacctcacttacgtgaggtgaagtaagtgactcaatggaaccccaac

SEQ ID NO: 15681 - RNA, 257 nt, unidentified
  source 1..257: mol_type = other RNA; note = Related to NZ_JUJG01000015.1; note = Pectobacterium carotovorum
tttggggttccatcgtgaaacttagttgtagtggatgcactaatagtgtatcaactgccttcggcagcttaatcgatctgataggatgtcgacgagcacggattccgtcgctctttgtggaagctttcgccagagtgagtagtgatgtgcgcgtttgcgcgcgttcttatgcttctggcaacgaagcctgtgcgcaaacgcgcacatcacgacctcacttgcgtgaggtgaagtaagtgactcaatggaaccccaat

SEQ ID NO: 15682 - RNA, 270 nt, unidentified
  source 1..270: mol_type = other RNA; note = Related to NZ_CP091099.1; note = Pantoea agglomerans
tttggggttccgccgtgaaacttagctgtagtgggtacatttttaatgtaccaacttccaatgactatcctaaaaaccgtttttacggtatgactggacgtctacgagcccggattccgtcgctcgctgtaaaagctttcgccagagtgagtaatgatgcgcacttttgcgctcgttcttttgctttggggcaacgaagcctgtgcgcaaaagtgcacatcacgacctcacttgcgtgaggtaaagtaagtgacacagtggaaccccaat

SEQ ID NO: 15683 - RNA, 250 nt, unidentified
  source 1..250: mol_type = other RNA; note = Related to JAANQB010000011.1; note = Cronobacter sp.
tttggggttccgtcgtgaaacttagtcgtagtaggccattttttaataggtcgacttccattgacattctgaaagattgtctacgagcacggattccggagctctttgtaattgccctcgcaggagtgagtaatgatacgcgtttttgcgcgcgttcttatgcctttgagggcaacgagactgtgcgcaaaaacgcgcatcacgacctcactaacgtgaggtgaagtaagtgacgcaatggaaccccaat

SEQ ID NO: 15684 - RNA, 273 nt, unidentified
  source 1..273: mol_type = other RNA; note = Related to PPXQ01000003.1; note = Massilia sp.
ttcggggttccgtcgtgaagcttagtcgtagctgatacgcactggccgtatcagcttccgttgatgactcttagattcggtgcatcggtctatggggttgtcattgagcacggacttccgtcgctcattgtaggtgccgccgcttgagtgagtactaatgtgcgctttcgcgctcgttctcctgctcctccgggcgtcgaagcctttgcgcaaaagcgcacatcagaacctcacttgcgtgaggtgaagtaagttatgcaatggaaccccaat

SEQ ID NO: 15685 - RNA, 271 nt, unidentified
  source 1..271: mol_type = other RNA; note = Related to JADJBR010000009.1; note = Zoogloea sp.
tctggggttccagcgtgaagcttagtcgtagtggatgggcgaattgctcgtcgacttccgttgattacttgtggattcgtgaagacggtcttccaggttttcatagagcacggattccgtcgctcgttgtaggagccgtcgctagagtgggttgggtcgtgcgcttttgcgctcgttctctgctccttcgggcggcgaagcctgtgcgcaaaagcgcacgacccgacctcactaacgtgaggtgaagtaagtgacgcattggaaccccaac

SEQ ID NO: 15686 - RNA, 273 nt, Achromobacter sp.
  source 1..273: mol_type = other RNA; note = Related to CADILF010000059.1; note = Achromobacter deleyi
tttggggttccaacgcaatgcttagtcgaagcggtgccatttaaaggcatctttttcgttgattacttgagttcgtgctatatgagcggctcgtcaggtgttcaaggagtgcggattccgctactcgtcgtaagagtcgtcgctagagtgagttgtagcgtgcgctttcgcgctcgttctctgctccttcgggcggcgaagcctgtgcgcgaaagcgcacgctactacctcacttgcgtgaggtaaagtaagctatgcgttggaacccccatt

SEQ ID NO: 15687 - RNA, 271 nt, unidentified
  source 1..271: mol_type = other RNA; note = Related to JAEUMY010000005.1; note = Betaproteobacteria bacterium
cttggggtttcagcgtgaagcttagccgtagtggatgcgcgcttgtcgcatcgacttccgtcggaggctggttgattcgcgtagacggtctatctggctttcgtagagcacggattccgtcgctcgttgtaggtgccgtcgctagagtgggttctgaactgcgcctttgcgcgcgttctctgctcctccgggcggcgaagcctctgcgcaaatgcgcagttcaggacctcactagcgtgaggtaaagtaagtgacgcgctggaaccccaat

SEQ ID NO: 15688 - RNA, 240 nt, unidentified
  source 1..240: mol_type = other RNA; note = Related to NZ_ATWO01000001.1; note = Desulfotignum balticum
tatggggttccagcgtggaaattagctgtaattggttcgaagccaataccaatactgaccagatgattcgttatctggtttatggtagagcacggattccggcgctcattgtgaaagccaccgcttggagtagaccatacataggccattctgacacgcgtaaagagcgccttcatgccagaatgccctatgtatcctcactacgtgaggtttaagtaaatgacacgctggaaccccaac

SEQ ID NO: 15689 - RNA, 254 nt, unidentified
  source 1..254: mol_type = other RNA; note = Related to CP033575.1; note = Shewanella algae
tttggggttccaacgtgaagtttagccgtcggtggtgtaatgccatcaccagcacgctttggaggggtgaaccctttgaaacgtgtagagcgcggaatccgttgctcattgtggtagccctcgctggagtgaactatgcctcgcgttttaaagcgcgtggtctccgcttgaggctacacccagcctttgctttaaaacgcgaggcataccctcacttacgtgaggtaaagtaaatgaatcgttggaatcccaat

SEQ ID NO: 15690 - RNA, 232 nt, unidentified
  source 1..232: mol_type = other RNA; note = Related to NAHO01000032.1; note = Snodgrassella alvi
ttttaggattccagcgtgaaatttagtattgtctatagctaatataatattagttatggatcacagcttattaacttaagttgttatgagtgcggattccgctactctatgtaatagccgatgatgaatgagaactacatgatgttatttaatccttgtaagtcttcacattaaataacatcatgtacctcactacgtgagttaaagtaaatgaaacgctggaatccttatt

SEQ ID NO: 15691 - RNA, 195 nt, unidentified
  source 1..195: mol_type = other RNA; note = Related to NZ_JAHNZV010000197.1; note = Psychromonas antarctica
acttagggtttcatcgtgaaatttagtgttagctggtctaacttcagcagagagtggattccacttctcaatggaaatgtctactattgcgcaagggtaatgcaaaagctttgttcatgcgtaggcttcattccaaatcttttgcatcaccctcacttcgtgaggttaagtagatgaatcgatggaaccctaata

SEQ ID NO: 15692 - RNA, 195 nt, unidentified
  source 1..195: mol_type = other RNA; note = Related to NZ_KB905170.1; note = Colwellia piezophila
acttagggtttcatcgtgaaatttagtgttagctggtctgacttcagcagagagtggattccacttctcaatggaaatgtctactattgcgtaagggtaatacaaaaactttgttcatgcgtagccttcattccaaaccttttgcatcaccctcacttcgtgaggttaagtagatgaatcgatggaaccctaata

SEQ ID NO: 15693 - RNA, 193 nt, Vibrio sp.
  source 1..193: mol_type = other RNA; note = Related to CP010032.1; note = Vibrio anguillarum
cttggggttctgtcgtgaaatttagcgttagctggtctaacttcagcagagtgtggattccactactcaatggaaatgtctactatagcgaaaggatgaagcaaaagctttgttcacgcgtgggcttcattccaaaccttttgcttcaccctcacttcgtgaggttaagtaaatgaatcgatggaaccccaat

SEQ ID NO: 15694 - RNA, 193 nt, Enterobacter sp.
  source 1..193: mol_type = other RNA; note = Related to VWWR01000002.1
cttggggatccttcgtgaaatttagtgttagcctgactaacttcagcagagtatggattccattactcgatgggaatgttaactattgcgaacggatgaagcaaaagctttgttcacgcgtagccttcgttccaaagcttttgcttcaccctcacttcgtgaggttaagtaaatgaatcgttggatccccaat

SEQ ID NO: 15695 - RNA, 203 nt, unidentified
  source 1..203: mol_type = other RNA; note = Related to NZ_CP078092.1; note = Geobacter sulfurreducens
taaggggctccagagaaaatctagtgaaggcccaacctgagtgttgggtacgagtaggcagcggattccgcgagccattggaatagcacatgaatgaacaaggatattaatggcaaacgcttacgttcgtatgccttactacgttcgccattaatgtcctcgcttcgcgaggttgaagtagatgagtatctggagcccgcttt

SEQ ID NO: 15696 - RNA, 257 nt, unidentified
  source 1..257: mol_type = other RNA; note = Bacteroidetes bacterium; note = Related to PSRA01000192.1
ggtgtgttgatcggaggactatttagccgtctgaaaccagcgggacgactgctggaatcagacagattccacggatggttcgccattcatggatggggaagtcggacagacttctctggaaagaactgacgcgaagacggctttgccgtccttgagcgtcacgccccaattaccttcggtgtctcgggagggccgcgacgctcatggtcccttcgggccctagaaggcgaggtaaatggaaacctggtcaacacacc

SEQ ID NO: 15697 - RNA, 260 nt, unidentified
  source 1..260: mol_type = other RNA; note = Related to NZ_CP036298.1; note = Aureliella helgolandensis
ggtgtgctggccgggtgaccgttcagccgtctgagcaagttggcgctgccgatttgcttcagacagattccgatgacggctcgcctgattcggatggggaagtcggaaaggcttctctggaaagaactgacgccaagacggctgcgccgtccgtgagtgtcgcgccccttgatccttcggccagagtgtcttcggcggagcccgacactcatggccacaagggctaaaggtgacgtgaatggaaacttggtcagcacacc

SEQ ID NO: 15698 - RNA, 246 nt, unidentified
  source 1..246: mol_type = other RNA; note = Related to JAAXWO010000007.1; note = Chlorobiaceae bacterium
ggtgtgcaggccgggcaatcgttcagccgtctggctctggtaacggggttcagacagaatccaatggcagttcgctgtttgaggatggggatatcggacagatatctctggaaaaaactgacgcaaaggcggctttgccgccctcaagcgtctccatctcgccaccttcgtctgctcgtgcggacggagacgcttcaggcaccatcggcttgaaggagaagtgaatggatgcctggtcagtacatc

SEQ ID NO: 15699 - RNA, 258 nt, unidentified
  source 1..258: mol_type = other RNA; note = Related to PNKZ01000003.1; note = Pirellula sp.
ggtgtgctgatcaggagaccgtttagccgtctggcgtgatcgtaaaacgacgcgttcagacagaatcgccggcggactgtctgccggcgatggggaagtcggacagacttctctggaaagaactgtcgctaggatggcttcgccatccataagcggcacggtccttttccctttggcccgagtgtctgtggtcggcccgcgccgctcacggccccagggggcttacggagacgtaaatggaaacttggtcagcacacc

SEQ ID NO: 15700 - RNA, 248 nt, unidentified
  source 1..248: mol_type = other RNA; note = Related to CP045236.1; note = Burkholderia cepacia
ggagtgccggctagtcagacgctcagccgttttcattctctgccagttgtgacagaaaatgaaaacagaatccaccgatggtgggtggatgggaaggccagaccggtctttctgggaagatctgacgcaatggcggctacgccgccctactctatcgagctccacatcctgcggcgactcgtaaggacctcgatagtgtaagacccaagggtcgaaggagaggtgagtggaagactggtcggcacacc

SEQ ID NO: 15701 - RNA, 255 nt, unidentified
  source 1..255: mol_type = other RNA; note = Related to JAGRPC010000052.1; note = Verrucomicrobiae bacterium
ggtgtgttggccgggggaccgttcagccgtctggtccgattgaggcaactcgtcgggtgcaggcagaatccgaggccagcgtgctggctgaggatggggatgctggacaagcgtctctggaaaaaactgacgcgaggtcggctgcgccgcccttgagcgtcgtcacccagcaaccttcggggcctcgtgtgggcgacgatgctcatggcccgaagggcgaaagggataagtgaatggaaacctggtcaacacatc

SEQ ID NO: 15702 - RNA, 261 nt, unidentified
  source 1..261: mol_type = other RNA; note = Related to NZ_SJPT01000002.1; note = Novipirellula galeiformis
ggtgtgctggccgggagaccgttcagccgactggcttggatcgcgaaagcgggcaagttcagtcagaatcggaaactggcttgccagtggaagatggggaatccggaatgggttctctggaaagaactgacgcaaagacggctccgccgtccttgtctgtcatgacgcaagttccttcgacgttgcctcctcgggagcgccatgacagacatggccctttcggctcaagtgagacgtgaatggaaacttggtcagcacacc

SEQ ID NO: 15703 - RNA, 254 nt, unidentified
  source 1..254: mol_type = other RNA; note = Related to SHMQ01000020.1; note = Candidatus Acidulodesulfobacterium acidiphilum
ggtgtgctgaccagtcttccattcagccgtttgcctaaaaaacaaacagattcagcatctcgcagtcaaaatgcgtggaggctgatggggaaatcagttcggtttctctggaaagaactgacgcaaggacggctttgccgtccatgtttgtcaaatctcaaataccttcggggtctcggaagagatttgacaatcatggtcccttggaccatgattatataaggagaagtgagtggaagactggtcaacacacc

SEQ ID NO: 15704 - RNA, 255 nt, unidentified
  source 1..255: mol_type = other RNA; note = Lachnospiraceae bacterium; note = Related to DNVK01000297.1
ggtgtgttggccaggggactgttcagccgtctggcctgatggagttaccatgaggaacagacagaatccacgaatgctttgcgtgacgtggatgggaaggccggacaggcttttctggaaagaactgatgcaaggacggcttcgccgtccatcaatgtcatgccacagaatccattcggtgtctcggaaatggcatgacattcatggcccttacgggctgagaggtgatgtgaatggaagcctggtcaacacacc

SEQ ID NO: 15705 - RNA, 262 nt, unidentified
  source 1..262: mol_type = other RNA; note = Related to NZ_QGKL01000023.1; note = Leucothrix arctica
ggtgcgctgactagttgatgttcagccatgtacaatgctctgtagtggttttatacgagtggtgtatatatattctgattagatgttatatctgtgatgatgggagagtcggatagattcttctggaaaaaactgatgttaaggtggctttgccacccgtgtgtgtcacacaaaaccgactagatcgtcttcggggtgtggtgcaacactcatggacccaagggttcaaaggagaggtgaatggagacttggtcagcacatc

SEQ ID NO: 15706 - RNA, 258 nt, unidentified
  source 1..258: mol_type = other RNA; note = Related to CABVQD010000004.1; note = Burkholderia sp.
ggtgtgctggccgggcgaccgttcagccgttgaccgatgatgaaggcagtgcctttcaggagtcgacaaattctgtcgtagcttctacatcgacagatggagatgtcggacaggcatctctggaaagatctgacgctaaggcggctgcgccgcccttcagtgtcatgccccaatcaccttcgatgtctcgggagagccatgacactgatggccccgtgggctcaaaggagaggtgaatggagacctggtcagtacacc

SEQ ID NO: 15707 - RNA, 255 nt, unidentified
  source 1..255: mol_type = other RNA; note = Gammaproteobacteria bacterium; note = Related to SSEJ01000200.1
ggtgtgctggccgggcaaccgttcagccgccaatccggaaggagcttgcttctcttgggttggcagattctgtagaggttttggcttttacggatggggatgtcggacagacatctctggaaagatctgacgctaaggcggctacgccgcccttcagtgtcatgcttcaatcacctgcggtgtctcgggagaaccatgacactgatggccccttgggctcaaaggataggtgaatggaagcctggtcagtacatc

SEQ ID NO: 15708 - RNA, 264 nt, Pseudomonas sp.
  source 1..264: mol_type = other RNA; note = Related to CVTP01000021.1
ggcgtactggccagtcgcccacttagccgcccaagcgtagtaaagtgctaagcgcaattactacgtgacaggctgattctgcctgagcctgactttggtagatggggatatcggatagatgtctctggtaagatcttacgctaagggcggcttcgccgcccttcatggccatgcaacaagatttcagcgatgacttggaagtcgcatggccgtgatggcccctagggtcaaaggagaggtaagtggaagactggtcagtacatc

SEQ ID NO: 15709 - RNA, 255 nt, unidentified
  source 1..255: mol_type = other RNA; note = Related to NC_008786.1; note = Verminephrobacter eiseniae
ggtgtgctggccgggtaaccgttcagccgctgactgatggagactcagtctctcaaaggttggcagattccgtcgcagcctcggcttcggcggatggggatgtcggacagacatctctggaaggaactgacgccaaggcggctacgccgcccttcggtgtcacgtcccatgcaccttcggcgtctcgggagagacgcgacaccgatggccccttgggctcaaaggagaggtgaatggaagcctggtcagtacacc

SEQ ID NO: 15710 - RNA, 255 nt, Pseudomonas sp.
  source 1..255: mol_type = other RNA; note = Related to DAFPEA010000002.1; note = Pseudomonas aeruginosa
ggtgtgctggccgggtaaccgttcagccgccgaccgatggagaccctgtctctgtgaggtcggcagattctgttgaagtctcggcttctgcggatggggatgtcggacagatatctctggaaggaactgacgccaaggcggctacgccgcccttcggtgtcacgtcccaatcaccttcgttgtctcgggagagacgcgacaccgatggccccttgggctcaaaggagaggtgaatggaggcctggtcagtacacc

SEQ ID NO: 15711 - RNA, 246 nt, unidentified
  source 1..246: mol_type = other RNA; note = Related to JADZHH010000033.1; note = Shewanella algae
ggtgtgctggccaagttaacattcagccgttgacaggtgactctcacctgtcgactgattctgtagaagcctttacttttacggatggggatgtcggagaggcatctctggaaagatctgacgctaaggcggctgagccgccctttagtatcatgcctcaatcaccttcggtgtctcgtaagagccatgatactaatggccccctgggctcaaaggagaggtgaatggaaacttggtcagtacacc

SEQ ID NO: 15712 - RNA, 257 nt, unidentified
  source 1..257: mol_type = other RNA; note = Related to NZ_CP012264.1; note = Cronobacter condimenti
ggtgtgctgatcagcactccgttcagccgttaaacaatgatgagtgaaattcaccgcttgtttgacagaatctgttgtggcttttgttacaacggatggggatgttggagaaacatctctggaaagatctgacgcaaaggcggctacgccgcccttcaatgtcatacattaacggccatcgaggactcggaaaatgtatgacactgatggccccctgggctcaaaggataggtgaatggaaatctggtcagcacacc

SEQ ID NO: 15713 - RNA, 258 nt, unidentified
  source 1..258: mol_type = other RNA; note = Related to JAAQVQ010000001.1; note = Providencia heimbachae
ggtgtgctgatcggtattctattcagccgttaaacaagaatgagtgatttatcaccacttgtttgacagattctgttgtagcttctgttacaatagatggggatgttggagaaacgtctctggcaagatctaacgctaaggcggctacgccgcccttcaatgtcataccttatgggccttcgaagactcggaaaatgtacgacactgatggccccctgggctcaaaggataggtgaatggaaatctggtcagtacacc

SEQ ID NO: 15714 - RNA, 256 nt, Salmonella sp.
  source 1..256: mol_type = other RNA; note = Related to AAMXLY010000014.1; note = Salmonella enterica
ggtgtgttgactagtgttctattcagccgccaatcatgagctgatgaggtaatcacggtctggttggctgattctgtagcacatgttgttatggatggggatgtcggagagacatctctggaaagatctgacgctaaggcggctacgccgcccttcaatgtcatacattaacggccttcggggactcggaatatgtatgacactgatggccccttgggttcaaaggataggtgaatggaaacctggtcaacacacc

SEQ ID NO: 15715 - RNA, 231 nt, Pseudomonas fluorescens
  source 1..231: mol_type = other RNA; note = Related to JAGGOG010000019.1
ggtgcgctgactaggaactttttagccgccctcatgcgagggtgaattgagatagccttggctagatcgatggggataccggataggcatctctggaatagtctgacgtttggggcggccagccgccccaccgatgccgtgaactctgaccgtcgaggtctcggaaatccacggcattggtggccccctgggcctaaaggagagggtaaatggtttcctggtcagcgcatc

SEQ ID NO: 15716 - RNA, 262 nt, Pasteurella sp.
  source 1..262: mol_type = other RNA; note = Related to BQFX01000025.1; note = Pasteurella canis
ggtgtgctgactcaaaatccatttagtcttcaatattagtggcttataaccattggtactgagaaatctaatgaaacctaatgtttcataggtggggatgtcggatagatatctctgaaaatatgtcacgtaatggcagtcaaactgcccttcaatatcaatcacagctattccatacgaagccttgggatgtgattgatattgatggttccctatcaggaacctcaaaggaaaaagtaaatggaaacttggtcagcacacc

SEQ ID NO: 15717 - RNA, 273 nt, unidentified
  source 1..273: mol_type = other RNA; note = Related to NZ_UEWY01000045.1; note = Haemophilus influenzae
ggtgtgctggctaaaatactatttagccatcaatcaatattatgagtctctatatctctaatattgaggttgaggaatctacgaaacttttagtttcataggtgggggtgttggatagacatctctggataaatctaatgtaaaggcagttagactgcccttcaatatcaatcctaactatttcctacgaagacttgggattaggattgatattgatggttcccccttggggaaccccaaaggtaaagtaaatggaaacttggtctgcacacc

SEQ ID NO: 15718 - RNA, 259 nt, unidentified
  source 1..259: mol_type = other RNA; note = Related to QEPO01000001.1; note = Haemophilus parainfluenzae
ggtgtgtggattaaaaaacatttagccatcaatattgttgatagtattgatgaatctgcgaaacttttagtttcataggtggggatattggataaatatctctggataaatcttatgttatggcagttagactgcccttcagcatcaatcctagcttttcctacgatgtctcgggataggattgatgttgatggttccccccctcgaacgggagggagaacccaaaaggaaaagtaaatggaaattttttctgcacacc

SEQ ID NO: 15719 - RNA, 249 nt, unidentified
  source 1..249: mol_type = other RNA; note = Related to NZ_CAJZCI010000001.1; note = Snodgrassella alvi
ggtgtgctgagcaataaactgttcagccgttgatatcacagatatcaacagaatctattgaagctttaagtaatatagatggggataccggataggcatctctggaaagatctgacgttagggcagttctgctgccctttactatcaagtcccaatgttttccttccgcagccttggatggaacttgatagtaatggttccctaaaggaactcaaaagggaaagtgaatggaaaattggtcagcacatc

SEQ ID NO: 15720 - RNA, 242 nt, unidentified
  source 1..242: mol_type = other RNA; note = Related to FR900422.1; note = Fusobacterium sp.
ggtgtattaatcaagcttctgctcagccgttcgctaataatacgcgaacagattcagataatattaattataatttatctgatgggggattcggattgaattctctggaaagaactgacgaaataacggcaaagccgtcctctatcattgaacctatctatccatcggggtctcgggtgcgcttcaatgataaaggtcatgaagactaaaggagtagtgagtggaagcttggtcaatacatc

SEQ ID NO: 15721 - RNA, 238 nt, unidentified
  source 1..238: mol_type = other RNA; note = Related to NZ_SMLM01000002.1; note = Ramlibacter henchirensis
ggtgtgccccttgaatccgcttagccgctcgcgccgtaaaggcgtgggcagaattcctgagcgcttgtcgtttgggaatggggaagccgggtaggcttctctgggaagatctgacgcaaaggcggcttcgccgcccaatatcgtcgtgccaaaatgaccttcggcgactcgtattcgccacgacgatgtcggacccgaggtcaaaggaagaagtaagtggaaacttggtcggcacacc

SEQ ID NO: 15722 - RNA, 277 nt, unidentified
  source 1..277: mol_type = other RNA; note = Related to NC_010334.1; note = Shewanella halifaxensis
ggtgtgctgattcaacctccaatcagccgcaaactcttctacaaaaagcgtcaaatgactcgtcaaatgaccaagaagaatttgcagattctatctgggatttttaaattctgatagatggggaaatcggagaggtttctctggaaaaaactgtcgcaatggcggcttcgccgccctagtatgtcatctctcagtatccatcgaagactcggtagagagacgacatactaggcccttgggcaaaaggtaaagtgaatggaaagttggtcagcacacc

SEQ ID NO: 15723 - RNA, 240 nt, Acinetobacter sp.
  source 1..240: mol_type = other RNA; note = Related to NZ_BKIP01000082.1; note = Acinetobacter lactucae
ggtgtagtgattaaacttaccattcagccgttattactctcgaaagaggttttaactgattctacaattgtagatgggaatattggataggtattcttggaaagaacttacgttaggccgatcaagtcggcctttatatgtgtgtgcccctaaaggaagccatcggagtcttgtagacacacacatataatggacacaaggtccaaaggattaggtgaatggaaatttggtcactacatc

SEQ ID NO: 15724 - RNA, 256 nt, Acinetobacter sp.
  source 1..256: mol_type = other RNA; note = Related to NZ_LMED01000026.1
ggtgtagtgattaagtttcactattcagccgttactgctctctacctaatagagactttaactgattctacaattgtagatgggaatatcggatagatatttttggaaagaactcacgataggtcgataaaatcgacctttatatgtatgcgcctttgaagtgaacttcaatagaccttcgaagccttgtagacgcatacatataatggacacaaggtccaaaggattaggtgaatggaaacttggtcactacacc

SEQ ID NO: 15725 - RNA, 240 nt, Acinetobacter sp.
  source 1..240: mol_type = other RNA; note = Related to CP029610.1; note = Acinetobacter pittii
ggtgtagtgattaaacttaccattcagccgttattgctctctaagggagctttaactgattctacaagtgtagatgggaatatcggatagatatttttggaaagaactcacgttaggccgatcaagtcggcctttatatgtgtgtgcccctaaaggaagccatcggagtcttgtagacacacacatataatggacacaaggtccaaaggattaggtgaatggaagtttggtcactacatc

SEQ ID NO: 15726 - RNA, 273 nt, unidentified
  source 1..273: mol_type = other RNA; note = Deltaproteobacteria bacterium; note = Related to QMMV01000171.1
ggtgtgccagccaggggaccattcagccgtctccctctgggtttatcaatccagggaagacagattctgccgcagtgatgtcggcagatggggaagtcggaaaggcttctctggcaagaaccgacgctacggcggctacgccgcccgtgacgccggacgctaccgcgtccgtcaatgtcgtgtcccaacggccttcgaagcctcggaagggccacgacattcacggccccaaggggctgaaggaggagtgaatggaaacctggtcggcacacc

SEQ ID NO: 15727 - RNA, 223 nt, Vibrio parahaemolyticus; identical to SEQ ID NO: 15664
  source 1..223: mol_type = other RNA; note = Related to CP006008.1

SEQ ID NO: 15728 - RNA, 198 nt, unidentified
  source 1..198: mol_type = other RNA; note = Related to NZ_KE150238.1; note = Bilophila wadsworthia
tatgggggatactcatgtatctagcggtcgcctgcttttcttagtgaagagcagcatgggacggatttccgaaccagcaaagttgtaacatgtcttcgacattcatgtgctcgccttattactccggagcctcgtgaacggcaagcacatgaatctcgcttcgcgagttaaaagtagatgcaaagagtatcccccaat

SEQ ID NO: 15729 - RNA, 204 nt, Desulfovibrio sp.
  source 1..204: mol_type = other RNA; note = Related to JAJQDW010000013.1
agtatagggggaaagttgcgatctagcacttcggcctgtgtttgttcacagcctggggaacggaatccgaacccttgcattgaagcaccttttaaactgcgatatagctacgtgagtccttgaggctccggggtctcacaaggactcacgcagctatttcgcgccttgcgctaaaagtagatgcagcaactttctccctatact

SEQ ID NO: 15730 - RNA, 206 nt, unidentified
  source 1..206: mol_type = other RNA; note = Related to NZ_JHVB01000001.1; note = Treponema sp.
ttgcaggcaccaaattattagtctagctactcgtaatgagacctgttttaaaaacatttggaaagacagatttctgtttttcttggtaaaatcgaccgcttaatatttctgtcaatggaagcctcgttcctacgcagtggcttgggtcgtttccattgatagatatacatcatggttaaagtagatgaaaatttggcagcctgctc

SEQ ID NO: 15731 - RNA, 246 nt, unidentified
  source 1..246: mol_type = other RNA; note = Related to JAFIBQ010000001.1; note = Arthrobacter sp.
ggtgaggagatggtagaaggtggcctagaaatgaagttgcggcgtcgtcgtgactcgttgagcgatatcgctcaagtggttcgttttcgaacctcggtgccccggatagccggcgcattcggactagctcgcgcaacgcgtgcaagcacggacaggccgccctgcgtgtgccttcgggctcttcctgcccgtggatccctccgggatctcccatcagagtaggcccaaatttgccatctcctcatc

SEQ ID NO: 15732 - RNA, 245 nt, unidentified
  source 1..245: mol_type = other RNA; note = Related to SOHL01000027.1; note = Cryobacterium sp.
ggtgaggagaccggtgcccggacacctagtgatgaagtcgggacgtcgttccgactcgttgagcattcgtgctcaagcgattcttcttagaattgcgggatcttcgcaaacggagattctcggacaagctcacgcaacgcgtgtgtgcacggacaagacgccctgcgttgtctccgggctcctcttgcccgtgaatccctggcgggatttcgagtcagagtagatgtccacaccgtcccctcacc

SEQ ID NO: 15733 - RNA, 239 nt, unidentified
  source 1..239: mol_type = other RNA; note = Related to NZ_PJJL01000059.1; note = Cryobacterium sp.
ggtgagaggaaagttttttagtctagagatgaagtcgtgacgttgtcatgactcggtcggtgaaagctcgatgatccgcattcggatcggggtcatagcaaactatgactttcggactagctgtcgcaacgcgtgtacctgcggacaaaccgcccctacggggacttcaggctccctttgcccgcacatccctacgggatagaagaactcaaagtagatgacgaagctttcctctcacc

SEQ ID NO: 15734 - RNA, 219 nt, unidentified
  source 1..219: mol_type = other RNA; note = Related to NZ_QETB01000005.1; note = Proposed Ancrocorticia populi
ttggagagatcgcagcgaagcggttgtgccagttttctggctcgaagggttgaggggattcccctcaatctggggtgcggctgaccgtgctctacggaagagcttccgcaatggttgggcggcggcagctatctgctacgcatctacctgccgtcccgccccgttccggcaactctccgtttgacaacgtcgagatcaaagttagttgcgatcctccac

SEQ ID NO: 15735 - RNA, 218 nt, unidentified
  source 1..218: mol_type = other RNA; note = Related to RKHG01000001.1; note = Luteococcus japonicus
gatgaggagcatccgtaggtgcgcctagattgccacccatcgcggtggtcggatctcgggttggacttctaaagtcccgcctccgcacgagcttccgctacgcctgagttgcgacctcccacccccggtggcgtgtgcctttccgggtgcaggagcccgcaaccgaggggacttcgtcaaaatattgggtaggttcatgtctatagatgctcctcatc

SEQ ID NO: 15736 - RNA, 232 nt, unidentified
  source 1..232: mol_type = other RNA; note = Related to NZ_VSSB01000001.1; note = Agromyces mariniharenae
ggtgaggagggagcgttcgcttagtgatgaagctgccgccttgcggcagctcgctagggcgcaaccacagtgttgcgcccgtaggtcctggctaaccacgaccgtaggacgagccgaggctacgcgtggagctggatggcaagttcctgtcctcgatgactcggggccttcccatccagacctgcgtgaccctgccgggtcgaagggtaagtgaacatgcgccctcctcacc

SEQ ID NO: 15737 - RNA, 216 nt, unidentified
  source 1..216: mol_type = other RNA; note = Related to JYIY01000074.1; note = Microbacterium ginsengisoli
gatgaggggaagaactggtctgcttagtgatgcagccggcacgttgtgtcggctcgtggagtcgactggctccaggacgcggctgaccgcgttcaccggacgagctcaggctacgcgtggtggggcaaacgccacctacctacggagcctggggaggcgttcgccccacccttcgggaccgggggtcaaagtaagtggctgacgcttcccctcatc

SEQ ID NO: 15738 - RNA, 218 nt, unidentified
  source 1..218: mol_type = other RNA; note = Related to CP096184.1; note = Demequina sp.
ggtgaggagagaaccgcgttacttagagacccgatcagcacgtagtgctgatccgaatggcacttgtgccttggggtacagctcactgtgctctgcggacgatcacacgcctccgcgtgaatcgacaagcgcgtcaggcctacgctgtctggcgacagcgctcgtcgatcccttcggggccggaggccaaaggtaagtgacaagggactctcctcacc

SEQ ID NO: 15739 - RNA, 214 nt, unidentified
  source 1..214: mol_type = other RNA; note = Related to WOXZ01000002.1; note = Rhodococcus sp.
gatgaggagtcgaggtggtgaatctaggacgccggtgcctcgcgccggcacgtcgagtcgaacggctcgaaggtcacggctgaccgtgatcgttggactatccctcgctacgcgtgcccgggcgaacgtgacatttcccgacgcgagctggggccacgtccgcccgacctgtcgggataacaccaaaagtagatgaacccctcgactcttcacc

SEQ ID NO: 15740 - RNA, 217 nt, unidentified
  source 1..217: mol_type = other RNA; note = Related to CP043474.1; note = Mycobacterium grossiae
ggtgaggagtcgggtggcgaacctagcggagtcggtgcatcgcaccgacggatcgagccaattggctcgaaggtcgcggctgaccgtgaccgtcggacaagctcccgctacgcatggtcaggcgaacctcgcctgccgacggagactggggcgacgtccgcctacccttccgggattacaccaaagtataagtagatgaaccatccggctcctcacc

SEQ ID NO: 15741 - RNA, 214 nt, unidentified
  source 1..214: mol_type = other RNA; note = Related to JAAVUN010000029.1; note = Kocuria subflava
gatggggagccgagtgggggatctagcgaagccgacgcctagtgtcggcgcatcgagtcgcaagactcgacggttgcggctgaccgtaaccgatggacgagccctcgctacgcgtggggaggcgaacctgcccaacgccgacgcaggctggggggcatgtccgcctacccttgcgggatgacaccgaagtagatgaaccactcgtctcctcatc

SEQ ID NO: 15742 - RNA, 212 nt, unidentified
  source 1..212: mol_type = other RNA; note = Related to SOCP01000015.1; note = Actinophytocola oryzae
ggtgaggagacttgtggaacacctagtgatgccgatacatggtatcggcgcgttgagtcctatggctcaatggttgcggctgactgcaaccgccggacgagcctgcgctacggttggcgaggcgaagccctctggcccgacggagactggggaggacttcgcctcccctgtcgggatatcaccaaagtagatggaccactcgtctcctcacc

SEQ ID NO: 15743 - RNA, 212 nt, unidentified
  source 1..212: mol_type = other RNA; note = Related to NZ_LMQC01000012.1; note = Modestobacter sp.
ggtgaggtggcgggaggcgcacctagtgaagccggtgccttgcaccggtcggtcgggccttctggcccgaggaccacgccttggcgtggtcatcggacgagctgccgctacgcgtggctgggcgagcacacttcgccgacgacgactggctgtgcactcgcccatcccttcgggaatacaccaaaagtagatgagccaaccgccacctcacc

SEQ ID NO: 15744 - RNA, 234 nt, Corynebacterium sp.
  source 1..234: mol_type = other RNA; note = Related to NZ_CP009220.1; note = Corynebacterium deserti
ggttaggggaaaaatggtaagtttagcgatagttactacgtcgtagtaacactcgccccatttgttggggtgtaagtttgatttggtgcacggaggaagccttagttttcctctgcggtcgagcggatgctctcttgctgcgcgcgggatgctctttacctacacgctcgttccgaaagagcctcccgcaccccaggcaaggctcagagtaaatgaacaatttttcccctaatc

SEQ ID NO: 15745 - RNA, 217 nt, unidentified
  source 1..217: mol_type = other RNA; note = Related to PVTL01000007.1; note = Glaciihabitans tibetensis
attgagatgagacgcgtgaacagcctagagatgaagcctgctaaaaaagcaggctcgggcatcgaaaggtgtcaggttgcagcgctctgtgatcggcggccaagccatcgattcgaaggcgccgggaagcttccgcttcccgaagcctcgaaaagcggaagctccccgccccttcgggggaggattaaagtaggtgactagcgcgcctcatctcaac

SEQ ID NO: 15746 - RNA, 219 nt, unidentified
  source 1..219: mol_type = other RNA; note = Related to NZ_QHLY01000005.1; note = Cryobacterium arcticum
actgaggtgagattcgtgcaatacctagggatgaagcctgtccatgcgacaggctcgggcatggaagcatgtcaggttgcagcactctgcggtcgccggccaagccagcgattcggaggcgacggtgaggctttcctccccgaagtctcgatgagaaaaccctcaccgtccccctccgggggaggttcaaagtaggtgcgtaacgaagcacacctcagt

SEQ ID NO: 15747 - RNA, 215 nt, unidentified
  source 1..215: mol_type = other RNA; note = Related to NZ_UXAU01000021.1; note = Arthrobacter ulcerisalmonis
actgaggtgaacgagtgaattacctagtgatgaagcctggcatattgcctggctcgggcaccgagaggtgtcaggttgtggcaatccacgaccggtggacaagcttccgattcggaggcgtcggtgagtgattcctcctcgaagtctcgacgaggaatcactccccacccctccggggaggttcgaagtaggtgagcacagacgcgcacctcagt

SEQ ID NO: 15748 - RNA, 219 nt, unidentified
  source 1..219: mol_type = other RNA; note = Related to JADKSK010000002.1; note = Plantibacter sp.
gctgaggtgagtgttgtatggaacctagtgttgaagcctggctaattgcttaggctcgggcgtcgagaggcgtcgggttgtgacaattcacaatcggcggccaagctatcgattcggcggtgatggtggggcctcgccccccgaagcctcgaagggcgaggccccaccatccccctccgggggagaatcagggtaggtcaagtgagcactcacctccgc

SEQ ID NO: 15749 - RNA, 185 nt, unidentified
  source 1..185: mol_type = other RNA; note = Related to NZ_CP080029.1; note = Streptomyces anulatus
gctcagggaggggcgctgagatctagtactgccggttccgtcgggaccggcccagccgggtctccttcgtggagccccggaggcagggcggcaccgtgggtgccgtccgtgaatcaactcccgcgtgacctggaaggtctggccggggggaacgcaaaggtagatggtcagcgcctcccctcatc

SEQ ID NO: 15750 - RNA, 185 nt, unidentified
  source 1..185: mol_type = other RNA; note = Related to BMRN01000021.1; note = Streptomyces atratus
gctcagggaggggcgctgagatctagtactgccggttccgtcgggaccggcccaaccgggtctcttcacagggcccgggggcagggtggcgtcgtgggcgctgcccgtgaatcaacttccgcgtgaccgtgtggtcgggccgtcggaaggaaagtaaaggtagatggtcagcgcctcccctcacc

SEQ ID NO: 15751 - RNA, 232 nt, unidentified
  source 1..232: mol_type = other RNA; note = Related to NZ_FMCR01000007.1; note = Micromonospora saelicesensis
cctgaggggagccgtgtgacatctagatccaggtcggcccgtcgggtcgaccacggccgcagcgagtccgcggtgcgagagcgggccgtgagtttctcacgcgctccgttcaatcccacgttcgcgtgcggtcgcgaagacgctgcatcctcgatgcctcggcgcgtcttcgcgaccccgctgccgcgatgggaaggaattcaaaggtagatgactatcggctcccctcacc

SEQ ID NO: 15752 - RNA, 230 nt, unidentified
  source 1..230: mol_type = other RNA; note = Related to NZ_BOML01000042.1; note = Actinoplanes durhamensis
gctgaggggagccatgtgacatctagatccgagtcggcccgtcgggtcgaccacggctgcgggcaaaccgcggtgcgcaagcgggtcgtgggtttactgcgactccgttcaatctcgcgttcgcgtgggtcgcgaaggcgctgcatcctcggcgcctcggcgcaccttcgcgaccatgctgccgcgcgagaaaggaatccaaaggtagatgacgactggctcccctcacc

SEQ ID NO: 15753 - RNA, 235 nt, unidentified
  source 1..235: mol_type = other RNA; note = Related to JAAGNB010000860.1; note = Amycolatopsis sp.
actgaggggggtcgatgacttctagttatccggtatcgttgatgccggggcggccggaacggtcttccgtttcggggcatacgtgcaggcgacagattgcactgtcgtctcgatcaaacccacgttacgccgagtggtgcaacgcgaagctccgggtcgatgtctccgggttcgcgttgcaccattcgctccgctgaagggccccaaaggtagatgatcaccgactcccctcatc

SEQ ID NO: 15754 - RNA, 227 nt, unidentified
  source 1..227: mol_type = other RNA; note = Related to NZ_LIRL01000059.1; note = Streptomyces niveiscabiei
cctgaggggggtccgtgacgtctagcgtctgtcgatgccgttggtgtcgacaccgccgggttggacccggggcttatgcaggcggcgggatacccgcaagcctggaccaaacccgcgcttcgcctcctgccgtgaaccgcgctgctccggcgatgtcttgggcgcggctcacggcacgactggcgtcgcggaggctcaaaggtagatgatcactggctcccctcacc

SEQ ID NO: 15755 - RNA, 204 nt, unidentified
  source 1..204: mol_type = other RNA; note = Related to NZ_BLPF01000004.1; note = Phytohabitans houttuyneae
attgaggggagtcggtgcgatctagataccgtcggggccgttggccccgacacagctagccggcgccgttggcgccggcgttggtcaagcccgcgcaagcgcctggaacgagtggcgtgcctggtccctcggggcctcggcgtcacgccactcggccctgccgggcggagaatcgaaggtagatgcgcaccgactcccctcacc

SEQ ID NO: 15756 - RNA, 216 nt, unidentified
  source 1..216: mol_type = other RNA; note = Related to BOPG01000023.1; note = Virgisporangium aurantiacum
cttgaggggggccgttgacatctagaaccgtcggagccgtcggctccgacacaggggcgacgagtccgttgccggcaccgtgggtgccggcgttggtcaagcctgcgctcgcgtctggaaacgcgtggcgtgccttaccctcggggtctcggccgtcacaccacgcggcaccctccgggtgcatccgaaggtagatgactatcggcccccctcacc

SEQ ID NO: 15757 - RNA, 225 nt, unidentified
  source 1..225: mol_type = other RNA; note = Related to CP063844.1; note = Streptomyces sp.
gcgggagagtcggtgacggcctagcgcaatcgacgaggtcatcgtcgagtcaacggtctgcatttgcaggtcaggctgcggtcgtgagccgcacgctgtggacaagctgtcgaacgcctggatggtgcgaggcgcacgtgctcctacgggggtctggcgcgcgactcgcaccagcccgccggggcgggatacaccgaaggtaggccaccccatcgactctcccgc

SEQ ID NO: 15758 - RNA, 233 nt, unidentified
  source 1..233: mol_type = other RNA; note = Related to SISL01000011.1; note = Verrucosispora sp.
gcttagggggagtcggtgacacctagagatgtcggtggggcttgctgggcaggctgcatcgacgcagatggcccgcaaggcgggccaggcggatggcgttgccgatccgctgtggagaaacctccgaagcgcatgcggcgcgaagcccaggcttctcctacgtgggcctggggcgtgggcttcgcgaccctggcgggatggcaccaaaggtagatgtcaaccgactcccccgc

SEQ ID NO: 15759 - RNA, 230 nt, unidentified
  source 1..230: mol_type = other RNA; note = Related to SSXE01000007.1; note = Nonomuraea sp.
gttgaggagggccggtgacatctagtgcgtccgatacctcgcgtatcgacgcggaatggtggttgttccgacgaccacccggcattcgatgtgatcgggtgctgcggacgatcctgctaccgcctgaggggtgtcctcgcgcttcctcctacggggcctggcgcgagaggacacccttgggcttcaggcggaaggacatcaaaggtagatgatcaccgactcacctcacc

SEQ ID NO: 15760 - RNA, 232 nt, unidentified
  source 1..232: mol_type = other RNA; note = Related to SAUN01000001.1; note = Nonomuraea polychroma
actgaggagagcccgtgagatctagagttgtccggtgccgagagggtatcggcgagatgggcggctattttgcagccgcctgggcgcacggcgtagtcgtgcgctgcggacaagctcctgaccgcctgcccgggaaactcgccctgatcctacgtgagcctggggtcgagttccccgcgctagccagcggacaagggacatcaaaggtagatgatcactgactctcctcatc

SEQ ID NO: 15761 - RNA, 213 nt, unidentified
  source 1..213: mol_type = other RNA; note = Related to NZ_CP084582.1; note = Micromonospora aurantiaca
gctgaggagagtcgaggatgtttagcatccagcgtttcgacgctggcacgccgggcatagtccggcgggcaggggatgtcatcctctgcgttggccaagctctcgccgacgccgggcaagccgacggtgccgcgcgcggggccttcacttgcaccgccgcctgtccatcggcggaaggacttcaaaggtaaatgaccctcgactctcctcacc

SEQ ID NO: 15762 - RNA, 211 nt, unidentified
  source 1..211: mol_type = other RNA; note = Related to NZ_JAFEUC010000033.1; note = Micromonospora humida
cttgagggagtcgtaggcgtttagcggcccggcatcgtgccggcattcgccagggatgccctggcggcggagagggttaccctccgttgtggacaagcactcgctaccgccgggaacagcacagcgaacccgggcgtatgcctggggcacgctgcgctgcgcctgtcggcgtggggaggccaaaggtaaatgacctacgactccccccacc

SEQ ID NO: 15763 - RNA, 221 nt, unidentified
  source 1..221: mol_type = other RNA; note = Related to JACASO010000007.1; note = Pseudonocardia pini
gctgaggggggtcggtgacatctagtgattgctggcgccgtgggcgtcagcgcatcccgggcatgtcgtgtccgggagcgtcgagcgttgccgacgccgtggacaagctgacgctgcgccttagcaggcaaagcgcgtctgtcctcgtgtgcctcaggaagcgctctgcctgctccctggcgggaatacaccaaagtagatgatctccgactcccctcatc

SEQ ID NO: 15764 - RNA, 233 nt, unidentified
  source 1..233: mol_type = other RNA; note = Related to NC_014666.1; note = Frankia inefficax
gttgaggggagttggtggcatctagttgctccgaggtacgttctcgggccgatcggttccgtagagctacgctctacgagttccaaggcggatggcgtcgccatccgtttcgatcaagctctcgcctacgcctcctactgctgaacgagcgctatcctacgacgtctgggcactcgttcagcaccagcccggcgggattcaccaaaggtagatggtcatcgactcccctcacg

SEQ ID NO: 15765 - RNA, 217 nt, unidentified
  source 1..217: mol_type = other RNA; note = Related to SAQH01000043.1; note = Mesorhizobium sp.
ggtggggcgctgaatttagcgttgcccgcaagcttcggcttgcgggcgtccacgttaggcaactaacagggcgagcgcgtcgcgctttgcttaggagaagcagccgccagtcgcgccggtggcgaagcggactaagggctctgcggggtctagggcgtccgctccgccatcgtctcgcgaagcgagtcaaagtaaatgacagtagcctcaccccacc

SEQ ID NO: 15766 - RNA, 219 nt, unidentified
  source 1..219: mol_type = other RNA; note = Related to JAFKIC010000112.1; note = Mesorhizobium sp.
gttgagggtgggacggtagcattttagcgttacttctactcagaagtgttccgtgtcgggtttccgacgtggcgggtgcgtcgcaccttgcttaggagaagccaacgccagtcgcgccggtggtggagtgaactcagttcttcacggagcctaaagcgttcactccaccatcgcctcgcggcggcgagccaaagtaaatgacttctatcccaccccact

SEQ ID NO: 15767 - RNA, 214 nt, unidentified
  source 1..214: mol_type = other RNA; note = Related to NZ_LNSC01000016.1; note = Sphingopyxis sp.
actgcgggcggggcgttaacagctagcgttgccgacgggtaaccgtcggtgtccatccggtaagccggcggccgagtgcttcgcattcggctggtaaaatcagccgccattcgcgccggcgagaagcaagacttcctctctcggggtctcaagccgtctcgcttctcgtcgtcacgggggtgaccaaagtagatgatcagcgcctcgccccacc

SEQ ID NO: 15768 - RNA, 207 nt, unidentified
  source 1..207: mol_type = other RNA; note = Related to NZ_JAGIOU010000001.1; note = Sphingomonas sp.
ggtggggcggtgacttctagccatgccgatcgttgatcggcctccacgtcgggaaaccggcagggaaagcgcgtcgcgcttacggaagaagcacccgccagacgcgccggtaggagaagggcccttcctctttcgtgatgactgcagggcttgccccttcccctatcgacccgcggatgcgccagagtagatgatctccgcctcacc

SEQ ID NO: 15769 - RNA, 222 nt, unidentified
  source 1..222: mol_type = other RNA; note = Related to NZ_CP016591.1; note = Tsuneonella dongtanensis
actgagggcggagcgctgagcatccagcttcccccggccgtaaaggccggaccaagtcgcggggttcccgcggcgggctggcgcgttgcgcttcgcctgggaaacggagtcgctgagatcgaccttagtgaagcgaacttccgctcttacgatgtctgggctcgtccgctccactatggcctccttacgggtcaaagtgaatgatcagcgcttcgccccacc

SEQ ID NO: 15770 - RNA, 222 nt, unidentified
  source 1..222: mol_type = other RNA; note = Related to NZ_WRPK01000013.1; note = Sphingomonas formosensis
actgagggcggagcgttgagcatccagcttcccccggccgtaaaggccggaccaagccgcggggttctcgcggcgggctggcgcgttgcgcttcgcctgggaaacggagtcgctgagatcgaccttagtgaagcgaacttccgctctgacgatgtctgggctcgtccgctccactatggcctccttacgggtcaaagtggatgatcagcgcttcgccccacc

SEQ ID NO: 15771 - RNA, 222 nt, unidentified
  source 1..222: mol_type = other RNA; note = Related to NZ_LMQP01000002.1; note = Sphingomonas sp.
gctgagggcggagcggtgagcatccagcctcccgccggccgcaaggccggtccatgccccggctcgtccggggcgggctggcgcgtcgcgcttcgcctgggagaaggtgtcgccgtgatcggccatggtgaagcggactccggcaccgacgaggactgggctcgtcccctccaccatcgcctcctatcgggtcaaagtggatgatcggcgcttcgccccacc

SEQ ID NO: 15772 - RNA, 236 nt, unidentified
  source 1..236: mol_type = other RNA; note = Related to LT629734.1; note = Agrococcus carbonis
ggtgaggcggctctacgaactagtgcagttgccgggttccggcaacgccggctcgggctggcagagtgtgcagcctgaggcgtccgcaggacgtgccggcaggagacctgtcggcatgagaaatcgaccgcttccggaagcagcgcgactctcgcttggttcctcggagcctcggcgcgagagccgcgcggcccctccggggccttatcgaaggtagccagtggagtcgcctcacc

SEQ ID NO: 15773 - RNA, 226 nt, unidentified
  source 1..226: mol_type = other RNA; note = Related to QKSO01000004.1; note = Curtobacterium sp.
ggtgaggggatcccgcgttagtcaagagtcggtaccgtcggtatcgatcgcccctagtagttgaaggggagccttgcggccgcttcgaatcggagattcggagcgtggaaaatctcccgcttccggaaggatcgcagcacccgcttccccctcgaagactcgggacgcgcgcgctgcgttgcccctccggggctatgaccaaaggtaacgatggaatcccctcacc

SEQ ID NO: 15774 - RNA, 258 nt, unidentified
  source 1..258: mol_type = other RNA; note = Related to JAINWC010000029.1; note = Agromyces mediolanus
ggtgaggaggctcgacgggactagcaaagcgccgccacgttacgtggcggccgtctctgcaaactcctgactgagttcacgagctagccagagaacgccgaacccggcgcatccgcgcgatactcgcgggtgagataaatctgtcgcttccggaaggatggcgaccctcgcttgcccctgcggcaggacttggacgcgagggccgcccgcccctccggggcactaatccaaggtagtcgccagtggagtctcctcacc

SEQ ID NO: 15775 - RNA, 230 nt, unidentified
  source 1..230: mol_type = other RNA; note = Related to NZ_RKQW01000003.1; note = Frondihabitans sp.
ggtgaggggaacgatcacggtcagaaaaagccggcaacgttggtgccggcactccgaagcatttgtcttcggcgtcgcgtgcgacgagggctaaatcgttgattgggcctgagcacaaactcacgattacgcagagcaagtcgaactcctctcggtcgctgtctcggtcgacgagcccgactgtccctccgggatcgatccaaggtgacctatgaaaacttcccctcacc

SEQ ID NO: 15776 - RNA, 251 nt, unidentified
  source 1..251: mol_type = other RNA; note = Related to PSVB01000001.1; note = Rathayibacter sp.
ggtgaggggaaggattcgggttagagaacgctcgcgaccatggtcgcgagccccacgcgcggcgctgccggaaggctgcaaagcacgatgcgtccatcggacgacgctcgccccggaggggtgggcgcggagaaaactggcgcttacggagacttccgagcgactcaaacaaagtcgcggtcttctccgttgagccgctcgcccctccggggcggacaactgaaggtaaccgttgaatctttctcctcacc

SEQ ID NO: 15777 - RNA, 254 nt, unidentified
  source 1..254: mol_type = other RNA; note = Related to JACFRS010000007.1; note = Bifidobacterium apousia
ggtgaggggaggtaagagtgatcttagcgatggttagcatatgctggcccgggagcggcgatttaaaactgctcgggaaagaagttcaaaagcccagaaacgcatttattagtttctgcgtacgatctcacgaacgcctgaaggtggagggttcaagcagcctacgaagtgcgactggctgctctcgagaaccctccacattcgctacgctctaccataggtcaaacagtaagtgatctctttctctcctcatc

SEQ ID NO: 15778 - RNA, 256 nt, Micrococcus sp.
  source 1..256: mol_type = other RNA; note = Related to NRSP01000001.1; note = Micrococcus luteus
gatgagggaggcttatttttgcctagtgttcccgaggatgagcaacttcctcggaggcggagttgaagtgattgtttcacataacttcgtatacagacgcaccccgctctgtattgggcctaaggagcttgggcctacggctaacgactcgcctcttggtgaatcggcggctcggccttacgtatcgttggcctttgcgagccgccgatgcgccttcggcgctgattcaaggtaggtaagatgagcccccctcacc

SEQ ID NO: 15779 - RNA, 221 nt, Pseudomonas fluorescens
  source 1..221: mol_type = other RNA; note = Related to NZ_JSAL01000022.1
ggcccacagaggctagtacgttagagtgtagtcgctctcaaggttaaggatttcgataaccgaatatcgcaaccatcagcggtgaagcgtgctgatggatgcgatgctccgccgcttcgcggctccgcagtcgaaaggcgcacaaaagcgggctccgcccgcttccgcacgcctttcgactaaagagcccgcttagtttagaaggtagtcatctgtgggct

SEQ ID NO: 15780 - RNA, 238 nt, Pseudomonas sp.
  source 1..238: mol_type = other RNA; note = Related to NZ_CP010979.1; note = Pseudomonas putida
tgcccgcagaagctagtatgctggagtgaagtcgctcccaaggttaaggttcatgataaccgatattgcaaacaccggcgatgaagcataccggcgcttgcaatgctacaacgcttcgcgtttccgcaaaccttgaggtgcacgaaagcgggcttcgcccactttcgcacacctcaaggtttagagcgcaagtctaaaagcaaaagcggattggaaaacaggtagctatctgcgggca

SEQ ID NO: 15781 - RNA, 217 nt, Pseudomonas sp.
  source 1..217: mol_type = other RNA; note = Related to NZ_UTCV01000052.1; note = Pseudomonas viridiflava
tgcccacagaggctagtacgatggagtgaagtcgctcccctggttaaggtgttcgataaccgatattgcatccaccggcggtgaagcataccggcggatgcaatgctacaacgcttcgcgtttccgcaaaccgcaaggcgcacaaaagcgggcttcgcccactttcgcacgcctcgcggtttagagcgcgagtctagaaggtagtcatctgtgggtt

SEQ ID NO: 15782 - RNA, 217 nt, Pseudomonas sp.
  source 1..217: mol_type = other RNA; note = Related to JAEKDB010000004.1; note = Pseudomonas haemolytica
tgcccacagaggctagtacgttggagtgcagtcgctccctaggttaaggtgtccgataaccgatattgcaaccactggcggtgaagcataccagtggctgcaatgctacaacgcttcgcgtttccgcaaaccgcaaggcgcacaaaagcgggcttcgcccacttccgtacgcctcgcggtttagagcgcaagtctagaaggtagccatctgtgggct

SEQ ID NO: 15783 - RNA, 219 nt, Pseudomonas sp.
  source 1..219: mol_type = other RNA; note = Related to NZ_JAGYGI010000002.1
tgcctgcagaggctagtacgtaggagtgtagtcgctccccgggtcaggttcccgataaccaagaatcatgcgctcagcggtgaagcatgctgaacgcatgatgcttacaaaacgcttcgcgttttgacgcagtaatctccagcgagaattccgcttcgcgcaattatcactggagattatctgaccatgctaaagtatagaaggtagcctctgtaggtt

SEQ ID NO: 15784 - RNA, 219 nt, Pseudomonas sp.
  source 1..219: mol_type = other RNA; note = Related to NZ_LHUU01000009.1; note = Pseudomonas protegens
cgcctacagaggctagtacgtaggagtgtagtcgctccccgggtcaggtttctgataaccaagaatcatgcgtccagcggtgaagcgtgctgaacgcatgatgctttcaaaacgcttcgcgttttgacgcagtaatctccagcaagaattgcgcttcgcgcaattatcactggagattatctggccatgctaaagtatagaaggtagcctctgtaggtt

SEQ ID NO: 15785 - RNA, 230 nt, Pseudomonas fluorescens
  source 1..230: mol_type = other RNA; note = Related to CABVIS010000011.1
tgcctgcagaggctagtacgttggagtgcagtcgctccccgggtaaggttcccgataaccaagttatagtaactccagcggtgaagcgtgctgaagttactatacttacaaaacgcttcgcgttttgacgtagtccactccatccgcaatttcgctgcgcgaaattacgaatggagtaaacaaagtcaaaagcaaagctgctaaagtacagaaggtagcctctgcaggta

SEQ ID NO: 15786 - RNA, 230 nt, Pseudomonas sp.
  source 1..230: mol_type = other RNA; note = Related to NZ_JAIWYL010000001.1
ggcctgcagaggctagtacgttggagtgtagtcgctccccgggtaaggttcccgataaccaagttgtagtgacttcagcgatgaagcgcactgaagccactacacttacaaaacgcttcgcgttttgacgttgctccacccatccgcaatttcgctgcgcgaaattacagatgggtaaaacaaagtcaaaagccaagctgctaaagtaaagaaggtagcctctgcaggtt

SEQ ID NO: 15787 - RNA, 229 nt, Pseudomonas sp.
  source 1..229: mol_type = other RNA; note = Related to NZ_CP027656.1; note = Pseudomonas chlororaphis
tgcctgcagaggctagtacgatggagtgaagtcgctccccgggtaaggttcccgataaccaagttgtagtaacttcagcgatgaagcgcactgaagttactacacttacaaaacgcttcgcgttttgacgtggtccatctattcgtaatttcgctgcgcaaaattacgaatagataaaacaaagtcaaaagcaaagcagctaaagtacagaaggtagcctctgcaggtt

SEQ ID NO: 15788 - RNA, 215 nt, Citrobacter sp.
  source 1..215: mol_type = other RNA; note = Related to CP045205.1; note = Citrobacter telavivensis
agcttacagaagctagtatgttggagtgtagtcgctccccgaactaaggttcgcgatagccaacactcaaggatgattttgtaccaaattcatccttgagttgacaaaaggactgcgtcctttgtgtcgggatcagaacacaataaaattagcgtatcgcaaattttattgcattctgatctgttgcaaagtattgaaggtatcttctgtaagct

SEQ ID NO: 15789 - RNA, 217 nt, unidentified
  source 1..217: mol_type = other RNA; note = Related to NC_012691.1; note = Tolumonas auensis
ggcttacagaagctagtacgttagagtgtagtcgctctccgggataaggctcccgttaaccaacgtacaataactattcaaaaagcgaatagttattgtaccgtaccaaaaggactccgtcctttgtggtagctcttaagttaagaaaatattgcgtgtcgcaatattttcttacttgaagaggggttgcaagtaaagaaggtagcttctgtaagct

SEQ ID NO: 15790 - RNA, 217 nt, unidentified
  source 1..217: mol_type = other RNA; note = Related to JABSQN010000005.1; note = Piscirickettsiaceae bacterium
ggcttgcagaagctagtatgttggagtgtagtcgctccccgaggtaaggccctcgttaaccatggttccataaagttgctatcgcatttatggtacttcaagaaatagctatcgctattcttgaaatagcataaaggagcctgtttttatgcgcatccgcataaaagcaggagcctttatgcttatgctaaagtatagaaggtagcttctgtgggtc

SEQ ID NO: 15791 - RNA, 218 nt, unidentified
  source 1..218: mol_type = other RNA; note = Related to NZ_CP036266.1; note = Gimesia chilikensis
aacttacagaagctagtacggtaagagtgtagtcgctctcaagggtaaggtgcccgttaaccatgtaccaccaaaagagagctaaagatctcttttggtggtgccatcgataaactcgtttatcgatggcagtcacacaagctcataaagtttgcgcgatcacaaactttacgatcttggagactgcatgcaagtccagaaggtagcttctgtaagtt

SEQ ID NO: 15792 - RNA, 202 nt, unidentified
  source 1..202: mol_type = other RNA; note = Related to NZ_CP081832.1; note = Idiomarina abyssalis
ggctctaagaagctagtagttttgagcgagtcgctcatgtggctgaggtttactttaaccgatgcaagaaaagcaaatgatgcaaaattttgccagcaaaattttgcatcaccactgaatcattaacaatagtcgcgtttcgcgactcttgcaaatgattcagtggtgtgcacgcaagtatagaaggttgtttcttagagcc

SEQ ID NO: 15793 - RNA, 233 nt, Pseudomonas sp.
  source 1..233: mol_type = other RNA; note = Related to CP049161.1; note = Pseudomonas aeruginosa
agcttacagaagctagtacgttggagtgtagtcgctccccgggctaaggtgcccgttagccaagacatacaaaagcaaaagcgaaaggaagcttttatttttgtatgtacctaaagatttgaaaaaagactcaaatctttaggtagtactaaaatcaatcactttttgcgcacgcgcaaaaagcaattgatttatagtacgcttgcaagtacagaaggtagtttctgtaagct

SEQ ID NO: 15794 - RNA, 238 nt, unidentified
  source 1..238: mol_type = other RNA; note = Related to JAENMP010000010.1; note = Serratia fonticola
ggcttacagaagctagtatgttagagtggagtcgctctcatgattaggtccgggttaacccagttcatgggaattgcaaaattccgcaattcccatgatagtgataataaaacctcgcagcgaacgttttcgctgctcgcttttattatctggattgaatcagcaaatttttgcgttttcgcaaaattttgccgcttcaatccacaggctaaagtattgaaggtatcttctgtaagcc

SEQ ID NO: 15795 - RNA, 238 nt, unidentified
  source 1..238: mol_type = other RNA; note = Related to NZ_JPRU01000003.1; note = Buttiauxella noackiae
ggcttacagaagctagtatgttagagtggagtcgctctcatgataaggtctgggttaacccagttcatggaaattactgtaaccagtaatttccatgatgtggataataaaatctcacagcgaattttttcgctgctcgattttattatctggattggaccagcaaatttttgcgttttcgcaaaattttgccgtcccaatccacaggctaaagtattgaaggtatcttctgtaagcc

SEQ ID NO: 15796 - RNA, 238 nt, unidentified
  source 1..238: mol_type = other RNA; note = Related to NZ_ARWD01000001.1; note = Serratia plymuthica
ggcttacagaagctagtatgttagagtggagtcgctctcatgattaggttggggttaacccagttcatgggaattgcaaacttccgcaattcccatgatatgaataataaaaccgcacagcgaagtttttcgctgcacgcttttattatctggattgaatcagcaaatttttgcgttttcgcaaaattttgctgctccaatccacaggctaaagtattgaaggtatcttctgtaagcc

SEQ ID NO: 15797 - RNA, 238 nt, unidentified
  source 1..238: mol_type = other RNA; note = Related to NZ_JQHM01000002.1; note = Pectobacterium betavasculorum
ggcttacagaagctagtatgttagagtggagtcgctctcatgattaggtctgggttaacccagttccaaggaattgcaatgctttgcaattccttggataatgataataaagcttcgcagcgaaacatttcgctactcacctttattatctggattgaatcagcaaatttttgcgatttcgcaaaattttgctgctccaatccactcgctaaagtattgaaggtatcttctgtaagcc

SEQ ID NO: 15798 - RNA, 239 nt, unidentified
  source 1..239: mol_type = other RNA; note = Related to CP026651.1; note = Morganella morganii
agcttacagaagctagtatgttagagtggtgtcgctctcatgattaggttcgagttaacccagttcgtgaaaattacaaaaaaatttgtaattttcacgatggtgacaacaaaaactcgtagcgaaattttcgctactcctttttgttgtctggattgtatcggataattttcgcgtattcgcaaaaattatccgccccaatccacaggctaaagtattgaaggtatcttctgtaagct

SEQ ID NO: 15799 - RNA, 235 nt, unidentified
  source 1..235: mol_type = other RNA; note = Related to CWJI01000001.1; note = Yersinia intermedia
ggcttacagaagctagtatgttagagtggtgtcgctcactagtttaggatcgcgttagcccagtccgtaaacctctcgttgttcggtttacggaagtgggcaatataaagctcgtagctcgttactcgctactcactttatattgccggttcgatccagcaattttttgcgttatcgcaaaaagttgctgcctcgaaccactggcttaaagtattgaaggtatcttctgtaagtc

SEQ ID NO: 15800 - RNA, 238 nt, unidentified
  source 1..238: mol_type = other RNA; note = Related to NZ_FXUX01000002.1; note = Pantoea agglomerans
ggcttacagaagctagtatgttagagtggagtcgctctcatgttaaggctggggttaacccagtccatgagaattactgaagtcagtaattctcatggggttgaaaataaattctcatagcgaagttattcgctattcgaatttatttccgggattaggtcagcaaatttttgcgctttcgcaaaattttgctgcccaaatccactggctaaagtattgaaggtatcttctgtaagtc

SEQ ID NO: 15801 - RNA, 210 nt, unidentified
  source 1..210: mol_type = other RNA; note = Related to NC_009659.1; note = Janthinobacterium sp.
ggatagccagtagctagtgttaaggagtggtgtcgctccggttgttcaggctgaatttttccagcccctgcaaatttaaacatcaaatttgcaggaatgtgaaattggctacgccaattatcactgatcacaacactaaatttgttcgttccgaacaaatgttagcgttgtgatcgcagctaacgtacagtaggtagcgttgtactatcc

SEQ ID NO: 15802 - RNA, 209 nt, unidentified
  source 1..209: mol_type = other RNA; note = Related to NZ_AJVC01000002.1; note = Herbaspirillum sp.
aagaggtagtagctagtgttaaggagtggtgtcgctccggttgataaggtgaaactatgcctgcgcccgaaaatttattctaaatttgtcggggggagactacgattggcaatgccaatcgtagtctcatctgaaccttacttttgttcgtctcgaacaaaagtaatcttcagatttcagctaacgtacagtaggtagcatttcctctt

SEQ ID NO: 15803 - RNA, 204 nt, unidentified
  source 1..204: mol_type = other RNA; note = Related to JAGPWD010000023.1; note = Massilia sp.
agtgcgcagtagctagtgtttaggagcggtgtcgctccggttgctgaggcggaaatatgccagcaccgggaaattggcttcgccattttcccggtgtgaaattggcttcgccaattatcacgtatttgattgactttgtaggtcgttccgacctacaaagccactctaatatgcagctagcgtacagtaggtagctccagcaca

SEQ ID NO: 15804 - RNA, 217 nt, Chromobacterium sp.
  source 1..217: mol_type = other RNA; note = Related to MUKQ01000009.1; note = Chromobacterium violaceum
tgagggagctgctagtgttaaggagtggtgtcgctccggttgctaaggctgatcttcaccagacaccgacaaatcactagaagtgatttgtcgggagcaagattgctgcagagcaactgcagcaatcgttgctagcaacaacgcatcatttgttcgaaccgaacaaatgatgtgttgttactgcagctaacgtctagttcggtagcaggctccctct

SEQ ID NO: 15805 - RNA, 220 nt, unidentified
  source 1..220: mol_type = other RNA; note = Related to PYUJ01000108.1; note = Serratia sp.
ggcttgtagaagctagtgcgttggagtgtagtcgctccttggttaaggtccattttaaccatcaactatggagaaattttgcacgcaaaattcctccatagtcgcttagaatagctacgctattcacgcggttctttcaagctcaagatgtcgcgttccgcaacatcttgagtttgaagagaacaggatgcaaaagtacagaaggtagattctacaagcc

SEQ ID NO: 15806 - RNA, 221 nt, Proteus sp.
  source 1..221: mol_type = other RNA; note = Related to CP047112.1; note = Proteus mirabilis
ggcttgtagaagctagtgcgttggagtggagtcgctccttggttaaggttaactttaaccattaccaatagaatcaatttgtacacaaattgattctattgggtcgcttagaatagctatgctattcacgcggttctttcaatctcaagattcgcggcccgcgaaatcttgagctcgaagagaacgaaatgcaaaggtacagaaggtagattctacaagcc

SEQ ID NO: 15807 - RNA, 219 nt, unidentified
  source 1..219: mol_type = other RNA; note = Related to NZ_JAKMAJ010000005.1; note = Brenneria sp.
ggcttgtggaagctagtgcgttggagtgtagtcgctccttggttaaggttcactttaaccaaagaccagacaagaattttgtaaccaaaattcccgtctggtcgcttcgaatagctatgctattctcgcggttctttcaagaacgagatgtcgcgtctcgcaacatctcgttctcgaagagaacgaactgcttagtatagaaggtagttttcacaagcc

SEQ ID NO: 15808 - RNA, 217 nt, Enterobacter sp.
  source 1..217: mol_type = other RNA; note = Related to CP084692.1; note = Enterobacter mori
ggcttgtgagtgctagcacgatggagtgtagtcgctccttggttaaggctgcctttaaccacagactcagcgtgagttttgttccaaatctcacgctgagtcgctccgaatagcgttgctattctacgcggttcatccaagttcaagatgttgcgatccgcaacatcttgttcttggaagaacggagtgtcgagtaagaaaagtagcctcacaagcc

SEQ ID NO: 15809 - RNA, 205 nt, Enterobacter sp.
  source 1..205: mol_type = other RNA; note = Related to JAEKKB010000005.1; note = Enterobacter asburiae
gacttgtagaaactagcacgttggagtgtagtcgctccttggttaagggtcactttaaccacgactatacggataactccgtatagtcgcttcgaatagcgttgctattctcgcggttctttcaaggtcgagatgtcgcgtcacgcaacatctcgctcttgaagagaacttaggtgtcaggtatagaaagtagtttctacaagtc

SEQ ID NO: 15810 - RNA, 211 nt, unidentified
  source 1..211: mol_type = other RNA; note = Related to JAHVIK010000003.1; note = Halomonas denitrificans
agtttgcaggagctagtacgtaggagtgtagtcgctccctggttaaggttcgcgttaaccaatcacttacaaactcaaagagcgagactttgtaagtgaagggaaaatggcttcgccatttgtcccgcagtcaatatctttgatattgcgccagcgcaatctaaaagatattgacagagttgcatagtaaagaaggtagctcctgcaaact

SEQ ID NO: 15811 - RNA, 217 nt, Vibrio sp.
  source 1..217: mol_type = other RNA; note = Related to NZ_FRFG01000024.1; note = Vibrio quintilis
agcttgcggaaactagcatattggagtgtagtcgctctgaagtttacgtcgataataacctagaactaaacacaaatttgcaagcaaaagtgtgtttagttcaccgaatagcattcgctattcttggtggcatcggttttgttctaaatattgcgtatcgcaatatttagaacaaaaccgatgagtagcaaagtatagaaagtagtttccgcaagct

SEQ ID NO: 15812 - RNA, 218 nt, Vibrio sp.
  source 1..218: mol_type = other RNA; note = Related to DADXPV010000013.1; note = Vibrio cholerae
agcttgcggaaactagcatagtagagtgaagtcgctctcaagttaaggctaataatagcctagaactaaacacaattttgcaagcaaaagttgtgtttagtaagccgaatagcattcgctattcttggctgcatcatttttgttctaaatattgcgtatcgcaatatttagttcaaaattgatgagtagcaaagtatagaaagtagtttccgcaagct

SEQ ID NO: 15813 - RNA, 210 nt, Vibrio parahaemolyticus
  source 1..210: mol_type = other RNA; note = Related to ABBBBM010000001.1
ggcttgtagaagctagtacgttggagtgtagtcgctctcaggttaaggtgaacgttaaccattatacttacgattttcggaaaagataaaaatcgtaagtagcatgaatagcttcgctattcttatggcattgaaatctcccatatttcgcgagcgaaatctgaaagattttaatgcaatgcatagtttagaaggtagcttctacaagtc

SEQ ID NO: 15814 - RNA, 212 nt, unidentified
  source 1..212: mol_type = other RNA; note = Related to NZ_MAJU01000008.1; note = Aliivibrio logei
agcttgcagaagctagtatgtaggagtgtagtcgctctcaggttaaggtagatgttaaccacaacttacaattttcaaaagagcgcgaaaattgtaagttgccgtgaatagcttcgctattcattcgggcattaaagctcaaatatcacgcaagcgcaatattcaagctttaatgataatgtgcaaagtatagaaggtagcttctgcaagct

SEQ ID NO: 15815 - RNA, 210 nt, unidentified
  source 1..210: mol_type = other RNA; note = Related to NZ_CP010423.1; note = Pragia fontium
aacctattgaagctagtacattagagtggagtcgctcttaggttaaggtagccgttaaccgtgtatctaaaatttcttgcagaaattttagatacagataggtaaataactttgttatttaccattaaaaacgtacaactttcgcatacgaaagttgtaaatttttaatgatgattgaacgcgtagtatagaaggtagcttcaataggta

SEQ ID NO: 15816 - RNA, 189 nt, unidentified
  source 1..189: mol_type = other RNA; note = Related to NZ_PNCO02000001.1; note = Pseudoalteromonas galatheae
ggcttgtagaagctagtacattagagtgaagtcgctctttggttaaggtgagctttagccacatcaaatataaaaaaccctgaatagcttcgctattctagttctgtatttaaaacttgaatgtttcgcgagcgaaacatgaaagttttaaatacttgtgcatagtaatgaaggtagcttctacaagct

SEQ ID NO: 15817 - RNA, 214 nt, Vibrio sp.
  source 1..214: mol_type = other RNA; note = Related to LJTE01000008.1; note = Vibrio alginolyticus
agcttgcagaagctagtacgttagagtgtagtcgctctcaggttaaggttttcgttaaccacattacttacaattttcgaaaagataaaaattgtaagtaagctgaatagcttcgctattcttaacgcgaacatgaaaatctcgaatattccgcaagcgaaatctacgagtttttcatgttagtgcatagtatagaaggtagtttctgcaagct

SEQ ID NO: 15818 - RNA, 212 nt, Vibrio parahaemolyticus
  source 1..212: mol_type = other RNA; note = Related to AAXXVD010000006.1
agcttgcagaagctagtacgttagagtgtagtcgctctcaggttaaggtttccgttaaccacggtacttacaattttcgaaaagataaaaattgtaagtaacatgaatagcttcgctattctataggaacatgaaaatctcgaatattccgcaagcgaaatctacgagtttttcatgttcgtgcctagtatagaaggtagtttctgcaagct

SEQ ID NO: 15819 - RNA, 219 nt, unidentified
  source 1..219: mol_type = other RNA; note = Related to NZ_LXEP01000041.1; note = Buttiauxella gaviniae
agcttgtagaggctagcacaatgggagtcaagttgaccccttggttaaggttacctttaacctcagtactaagttttgcacttcgtttaaaacttagtactatccacataaattcaagaatttatgtggatacaaaatttataaagcaaaatttgcgctaacgcaaattttctttataagattatggatcgcaagtatagagagtagcctctacaagca

SEQ ID NO: 15820 - RNA, 219 nt, Salmonella sp.
  source 1..219: mol_type = other RNA; note = Related to AAMMPP010000001.1; note = Salmonella enterica
agcttgtagaggctagcacagtgggagtcaagttgaccccttggttaaggttatctttaacctcagtactaagttttgcgctttgcttaaaacttagtactatccacataaattcaagaatttatgtggatacaaaatttataaagcaaaatttgcgctaacgcaaattttctttataagattatggatcgcaagtatagagagtagcctctacaagca

SEQ ID NO: 15821 - RNA, 244 nt, unidentified
  source 1..244: mol_type = other RNA; note = Related to WQRG01000008.1; note = Leclercia adecarboxylata
tgcttgtaaaggctagtataaaaggtgtcaagttgaccctaaggttaaggctatctttaacctcagtactaagtttttactttgtaaaaacttagtactactctcacaaattcatgaatttgtgagagtacataaattacaaagcgaaattttgcgctaacgcaaaatttactttgtaatattatggattcgcaagtgtaaaatattaatttaaagatcaaagaaagagtagcctttacaagca

SEQ ID NO: 15822 - RNA, 190 nt, Acinetobacter sp.
  source 1..190: mol_type = other RNA; note = Related to JAKUKP010000004.1; note = Acinetobacter pittii
gtctattagggattagtatattgaagtgtagtcgcttcttgtgttcaggggtcattgacctcatacctatataaattttttcaaaatttatataggtatcgatcaagcgttgcttgaatcgattctatcaacaaacccgttggtatttgttgatagaagtagcaagtattttgagtaatctctaataggc

SEQ ID NO: 15823 - RNA, 190 nt, Acinetobacter sp.
  source 1..190: mol_type = other RNA; note = Related to JACXZP010000005.1; note = Acinetobacter towneri
acctgttaggggttagtatattgaagtgatgtcgcttctcgtgtttaggggtcattgaccttgtacctatataaattttttcaaaatttatataggtaccgatcaagctttgcttggatcggttctatcaacaaaaccctaggttttttgttgatagaaaagcaagtattttgagtaatccctaataggt

SEQ ID NO: 15824 - RNA, 189 nt, Acinetobacter sp.
  source 1..189: mol_type = other RNA; note = Related to NZ_CP031716.1; note = Acinetobacter wuhouensis
acctgttagggattagtatattgaagtgatgtcgcttctcgtgtttagggttcattgaccttgtacctatattaattttttcaaaattaatataggtaccgatcaagctttgcttggctccgtcctatcaacaaaacccttggttttgttgatagaaatagcaagtattttgagtaatccctaataggt

SEQ ID NO: 15825 - RNA, 205 nt, Acinetobacter sp.
  source 1..205: mol_type = other RNA; note = Related to CP077835.1; note = Acinetobacter baumannii
tgcctgtaaggattagtattttgaagcgagtcgcttctgacgttaacgggtctttgaccttaactctctattaaatcaaagatttaatagagaggggcgaacagctgctgctgattcgcagtaagaaaagaagatttcttttgattgctatcaaaataaatttcttttcttacaaagcaagtaatttgagtaatccttacaggtt

SEQ ID NO: 15826 - RNA, 206 nt, Acinetobacter sp.
  source 1..206: mol_type = other RNA; note = Related to NZ_VPDZ01000001.1
agcctgtaaggattagtattttgaagcgagtcgcttctaatgttaacgggtctttgacctatactctctattaaatcaaagatttaatagagagggggcgaacagctgctgctgattcgcgtaagaaaataagatttcttttgattgctatcaaaataaacttcttttcttacatagcaagtaatttaaggtaatccttacaggtc

SEQ ID NO: 15827 - RNA, 199 nt, Acinetobacter sp.
  source 1..199: mol_type = other RNA; note = Related to CP035936.1; note = Acinetobacter cumulans
cacctgtaaggattagtatgttgaagtgtagtcgcttctagtgttaacgggtctatgacctttactctcattaaatcaaagatttaatgagagggtcgaacagcatttgctgattcgaagtaagaaacaaatttatttggatgtttcccaataaatttgtttcttacaaagcaagtaatttgagtaatccttacaggtt

SEQ ID NO: 15828 - RNA, 209 nt, Acinetobacter sp.
  source 1..209: mol_type = other RNA; note = Related to NZ_CP032134.1; note = Acinetobacter chinensis
cgcctatagagattagcaaattgaagtgaagtcgcttctagtgttaaggtctcaatgacctggacttaatctcgaaaatttatcaattttctcgtttaagtcgtgaacagctatcgctgattcacagtgataaacaaaatagcttttgctctacgcaaaatcaattttgtttatcacagagcaagtaaagaaagtaatctctataggtt

SEQ ID NO: 15829 - RNA, 224 nt, unidentified
  source 1..224: mol_type = other RNA; note = Related to NZ_PIPJ01000004.1; note = Aliidiomarina iranensis
tggctctcgagcctagttacctgtaaaagagtgcagtcgctctgggcttaaggtcagttttagcctcggtaaaagacgactccttaaaaatgttccatttttaaggagtgctcgcaccgctgcgcggtgactcgctggaaagattatcagtctttccgcgcgagcacggaaagactgataatctttccgcgggagcaaaagtttcgatgtaggatcgagagcca

SEQ ID NO: 15830 - RNA, 204 nt, unidentified
  source 1..204: mol_type = other RNA; note = Related to NZ_JAKZGR010000005.1; note = Belliella kenyensis
aggtggaatagaaacaagcattaaggaagcggtgtcgcttccgagaggtaaggctatatttaacctcggtcaaaaatcgcgatttttgacagctcactaggcaaagcctagtttcgctcacaataaacaaagttttattggagcgaactccaataaaactttgtttattgtgagagctgcgaatagaaagttgtttgaccacct

SEQ ID NO: 15831 - RNA, 202 nt, unidentified
  source 1..202: mol_type = other RNA; note = Related to HF992628.1; note = Prevotella sp.
ggaaaatagaaactagcatttaggaagtggtgtcgcttccgaaggctaaggttaattttagcctcagtagatagttcagagaactatctacagctcacttggcacagccaagattcgcattcaataaatattattttattgaagcgagctccaataaaataatatttattgacgagctgacgaatagaaagtagttttatcc

SEQ ID NO: 15832 - RNA, 215 nt, unidentified
  source 1..215: mol_type = other RNA; note = Related to NZ_JAAKEL010000031.1; note = Dysgonomonas sp.
aggtggaagaaactagcaaataagaagatgtagtcgtcttcgttgataaggtttattttagcctcagtgcatcaatgacccttcagctcattgatgcacagctcacaagacaagcatgtcttgattcgctccaataactaagtagtttattggagtgtccaataaactacttagttattggaacgagctacgagaagaaagtagtaaatccacct

SEQ ID NO: 15833 - RNA, 213 nt, unidentified
  source 1..213: mol_type = other RNA; note = Candidatus Cloacimonetes bacterium; note = Related to JAIPGO010000099.1
aggtggttatattctagtatttatgaagtgtagtcgcttcgatcgttaaggctgattttaacctctgcataataatatcggtagatattattatgcacgctccctttagcagagctaagaatcgctcactcaggcacaagctttgaggagcgacctcctcaaagcttgtgcctgagtgagagctaaagaaaagaaaagtagaataagccacct

SEQ ID NO: 15834 - RNA, 219 nt, unidentified
  source 1..219: mol_type = other RNA; note = Related to NC_015496.1; note = Dokdonia sp.
aggtggtatagaaactagcattaaggaagtgtagtcgcttccgaaggttaaggctaattttaaccttgagcataacaaatgaatgaaaaattcatttgttatgctcgcgaactgggcagagcccagattcgcgcacacaaactaatgttttgtgtcgcgaacaacacaaaacattagtttgtgtgaaagctgaagaatagaaagtagttctcaccacct

SEQ ID NO: 15835 - RNA, 209 nt, unidentified
  source 1..209: mol_type = other RNA; note = Related to NZ_JPRI01000002.1; note = Chryseobacterium vrystaatense
tggttgaaaaaactagcattaaggaagtgtagtcgcttccgaaggttaaggtgaattttaacctgtgtcataataaaatcaaaaattttattataacagctcactaagcagagcttagattcgctcacacacaaataagttttgtggagcgagcaccacaaaacttatttgtgtgtgaatgcttacgaaaagaaagtagttttccaccc

SEQ ID NO: 15836 - RNA, 213 nt, unidentified
  source 1..213: mol_type = other RNA; note = Related to JAGPCT010000083.1; note = Saprospiraceae bacterium
tgatgggtaagaaacttgcacttagaaggtgtagtcgccttcggccgaattcaggctaaatttagccaatgggctaaagtagaaataactttagcccctgttcgctcagcagagctgaggctcgctccacttaattacctcaaaagtggagcgaactccacttttgaggtaattaagtggattgctaaagcataagaaagaagtcgcccatca

SEQ ID NO: 15837 - RNA, 222 nt, unidentified
  source 1..222: mol_type = other RNA; note = Related to NZ_JACVMN010000002.1; note = Flagellimonas sp.
tgatggctaaaagaacttgcatttagaaggtgtagtcgccttcgtgaactaaggctagatttagccattgggaataaaattaaaatcagagattgtttattttattccggttcactcatcaaagatgagattcacgcacttaattaatatttaagtgtagcgtctccacttaaatattaatataagtggaatgctaaagatgaagaaagaagtttgccatca

SEQ ID NO: 15838 - RNA, 196 nt, unidentified
  source 1..196: mol_type = other RNA; note = Related to NZ_CP047897.1; note = Nibribacter sp.
aggtggaaaagaaactagcatattggaagcgagtcgcttcttgagttaaggttagatttaacctagggcaaagcaagtttgccagtttgctcggcagggccgagacaaactctcagtaatgatattattcgtcgtatcctccgaataatatcattactgaggttagctaaagtaaagaaagtagttttatccacct

SEQ ID NO: 15839 - RNA, 223 nt, unidentified
  source 1..223: mol_type = other RNA; note = Related to PCOU01000016.1; note = Chryseobacterium sp.
aggtatagaagaaactagtacaattgaagtgaagtcgcttcgtaggataaggtacactttatcctttacccttaaatacaaaattagaaattttttatttaagggttctcgctcagcagagctgagactcgcggtgattaatccaaattattttgtagattactccaaaataatcagtattaatcacaaagctaaagttaagaaagtagttaacttattacct

SEQ ID NO: 15840 - RNA, 223 nt, unidentified
  source 1..223: mol_type = other RNA; note = Related to JACHTC010000027.1; note = Myroides sp.
ggcacacaagaaactagtacaatcgaagtgaagtcgcttcgtaggataaggtatattttatcctctacctttaaattaaaaatcagagattttgaatttaaaggttctcgctcagcaaagctgagactcgcagtgattaatccatattattttggagaatactccaaaataatccgtcttaatcacatagctaaagttaagaaagtagtaactaattagtgtc

SEQ ID NO: 15841 - RNA, 219 nt, unidentified
  source 1..219: mol_type = other RNA; note = Related to NZ_NFHW01000007.1; note = Butyricimonas sp.
acaataaagaaactagcacatttgaagtgaagtcgcttctaaggttaaggtattctttaacctctactcttaataagcaaatcaaagatttgcttattaagagcgttcactcagcacagctgagattcacagtgattaattcagattattctggagcatactccacaataatcggccttaatcacagagcttacgttaagaaagtagtttaattaatgt

SEQ ID NO: 15842 - RNA, 193 nt, unidentified
  source 1..193: mol_type = other RNA; note = Clostridia bacterium; note = Related to JAFWZH010000322.1
agaaactagcaagtaggagtgtagtcgctccgatccgttaagggtttgatttaccccaactgaaaccatccagtattcagcgggcttgaacctatggttcaagctgtcaataattgctaaaatttatggtcgtaaccataaatttaatcaattattgacagggctcacgtaaagaaagtagtttatatcatct

SEQ ID NO: 15843 - RNA, 186 nt, unidentified
  source 1..186: mol_type = other RNA; note = Related to CP042465.1; note = Prevotella copri
gaatgttggaaactagaaaataggagtgtagtcgctccggcagggttaggctttgctttacccatcgaacaccacggtgttcgaagtcaaagtctatcgactttgacagcaacagattcatcaaaaatgcgatgcatttttaacgaatctgttgcaggcgttgttaggaaagtagttccagtaata

SEQ ID NO: 15844 - RNA, 243 nt, unidentified
  source 1..243: mol_type = other RNA; note = Related to WTAE01000072.1; note = Sulfurovum sp.
agaaaagcattagtacagaaaagagtgtagtcgctcttgattcaggttaattttaaccaccagtaggaaactttatgtcttcactcagtcgctgttcgctcgttcgttcagaaataaagtttcctactgaactccattccattacgtgcaaaactacaagaagacttcttatcgcgtccgataacaagtattcttgtacttttgagatgcgttaccgagaggtaagggtaatgcttttcttct

SEQ ID NO: 15845 - RNA, 193 nt, unidentified
  source 1..193: mol_type = other RNA; note = Related to NZ_CABVRY010000015.1; note = Aliarcobacter butzleri
cgatagtgtcagtaagtgtaagtgaagtcgcttaccactgagaggttatttttatcctttggtattaatttttcaaattaatactcggctacggataaatccttcgctcattatataaataaatcttattgattcgttaatcaataagatttattttataatgacagtaatacaagaaaaggtggcactatct

SEQ ID NO: 15846 - RNA, 176 nt, unidentified
  source 1..176: mol_type = other RNA; note = Lentisphaerae bacterium; note = Related to JABMQT010000738.1
ggcttctcgcattagcacgttgaggtgaattcgcctcacaggttaacggtagcgttagctccactggttgtggaacacaaccagtgcttcctcctgacggaggattgcagagatctagctcacatgcatgtgagctagaccccggagttctgctgagtttagtactgcctgaagcg

SEQ ID NO: 15847 - RNA, 191 nt, unidentified
  source 1..191: mol_type = other RNA; note = Related to NVRR01000003.1; note = Sneathiella sp.
gtgcgctagaggttagcacaaagaggtgtattcgcctcagggttaaggttcgctttaaccacttcgtagaaacctaagtgggcttctacgaggcttctctaacgagatgcttgccatagtcttaatcgttttggacgatttagctatgacaaggaatgtaaacattgaaaaggaagtagcttttagcgcac

SEQ ID NO: 15848 - RNA, 217 nt, unidentified
  source 1..217: mol_type = other RNA; note = Related to JAGQOP010000117.1; note = Phycisphaerales bacterium
gggtagcaaaatgctagtacaaaggagtgaagtcgctccgcggattaaggttgacgttatcctacgggacaagctgggataaaactccagcttgccccagcgatctcgatattcatcgaggatcgctcgcctaacatgcctgcgcactgcgcgagcgcacctactcagcatgttaggcggtagcgtgcgaagcacggatagaaggtagcggctaccc

SEQ ID NO: 15849 - RNA, 170 nt, unidentified
  source 1..170: mol_type = other RNA; note = Related to NZ_CADEUM010000003.1; note = Burkholderia cenocepacia
ggagtgcgcagattagtacgttgaggtgtatcgcctcgctgattgaagctggcgttagccccataatccctgacgggatttcatgtggcgctgactcgccacatgaaagcgtcggccctacgggccgcgttttcggagaaagtagcaggaagggtaatttgcgtgactcc

SEQ ID NO: 15850 - RNA, 163 nt, unidentified
  source 1..163: mol_type = other RNA; note = Related to NZ_FQXY01000011.1; note = Bacteroides sp.
tgagggcaaaatttagcacaaaagaggtgtagtcgcctcataagcacaggtattttcctagaaaataaattcttaggtataaataccttaaatttattttagtaaataactcatcctcttctctctttctttatatacatgatacaaaatggacggtatttta

SEQ ID NO: 15851 - RNA, 190 nt, unidentified
  source 1..190: mol_type = other RNA; note = Related to VWAM01000011.1; note = Bacteroides finegoldii
tgagggcagaatttagcatcaaagaggtgtagtcgcttcataagcacaggtattttcctagaaaataaattctaaggtataaatacctaaatttattttagtaaataactcatcctctcttctctcttttttatatgcatatacaaaatggacggaattttaataacgatcattgttatcaccgcttttc

SEQ ID NO: 15852 - RNA, 115 nt, unidentified
  source 1..115: mol_type = other RNA; note = Related to CP081916.1; note = Bacteroides faecis
ggatgaggaaaaatttagcagaaaagaggtgtagtcgcctcgcaggcacaggtattttcctggaaaataaatctctggtataaatacctctatttattttagtaaaatctcatcc

SEQ ID NO: 15853 - RNA, 117 nt, unidentified
  source 1..117: mol_type = other RNA; note = Related to FQZN01000002.1; note = Bacteroides stercorirosoris
ggatgagaaaaatatttagcaggaaagaggtgcagtcgcctcgtaagctcatgggctttcttagaatgtaaatactctggtatgaataccacgatttacattagtaaatactcatcc

SEQ ID NO: 15854 - RNA, 118 nt, unidentified
  source 1..118: mol_type = other RNA; note = Related to CP072251.1; note = Bacteroides cellulosilyticus
ggatgagaaaaagatttagcaggaaagaggtgcagtcgcctcgtaagctcaggagctttcttagaaatgtaaatactctggtataaataccacgatttacattagtaaatactcatcc

SEQ ID NO: 15855 - RNA, 113 nt, unidentified
  source 1..113: mol_type = other RNA; note = Related to SZUU01000003.1; note = Bacteroides fragilis
ggatgagataaagatttagcaaaaaagaggtgcagtcgcctcgtaaattcagggtttttctgattttctttattatgttgctcataagtaaagaaaagtaaataatctcatcc

SEQ ID NO: 15856 - RNA, 112 nt, unidentified
  source 1..112: mol_type = other RNA; note = Related to CP037440.1; note = Bacteroides fragilis
ggatgagataaagatttagcaaaaaagaggtgcagtcgcctcgtgaattcagggtctttctggatttctttattaagatactcataataaagaaaagtaaatactctcatcc

SEQ ID NO: 15857 - RNA, 111 nt, unidentified
  source 1..111: mol_type = other RNA; note = Related to CP036550.1; note = Bacteroides fragilis
ggatgagataaagatttagcaaaaaagaggtgcagtcgcctcatgaactcaggttctttctggtttctttattaagatactcataataaagaaaagtaaatactctcatcc

SEQ ID NO: 15858 - RNA, 112 nt, unidentified
  source 1..112: mol_type = other RNA; note = Related to RQYS01000018.1; note = Tannerella forsythia
aggtgagcagatattttagcatactgagaggtgtagtcgcctcattagttcaagtgttttcatagaaaagcatatttgtagacaaatatgctttaagtaaaagctctcacct

SEQ ID NO: 15859 - RNA, 148 nt, unidentified
  source 1..148: mol_type = other RNA; note = Related to JAEPKU010000005.1; note = Dysgonomonas sp.
ggatgagtaaaagatttagcaagaaagaggtgtagtcgcctcgttagttcatgtattttctgagatttaggaatgttctttattactacctaaatcttacagatttgcaggtgtactaaagaacattcctaaaagtaaacactcatcc

SEQ ID NO: 15860 - RNA, 148 nt, unidentified
  source 1..148: mol_type = other RNA; note = Related to NZ_GL891979.1; note = Dysgonomonas gadei
ggatgagtaaaagatttagcaaaaaagaggtgtagtcgcctcgttggttcatgccttttctgagattcagtaatactttgatttattacctgaacctttcagattcttaggtataaatcaaagtattactgaaagtaaacgcccatcc

SEQ ID NO: 15861 - RNA, 149 nt, unidentified
  source 1..149: mol_type = other RNA; note = Related to SELI01000017.1; note = Apibacter muscae
ggatgagttaaaatttagcaagaaagaggtgtagtcgcctcgttggttcatgcctttttctgagattcagtaataacttcgatttattacctgaacctttcagattcttaggtataaatccaagtattactgaaagtaaacgctcatcc

SEQ ID NO: 15862 - RNA, 150 nt, unidentified
  source 1..150: mol_type = other RNA; note = Related to NZ_OEPV01000016.1; note = Dysgonomonas sp.
ggatgagttgaaaatttagcaagaaagaggtgtagtcgcctcgttggttcatgcctttttctgagattctgtaataccttgattgtattacctgaatccttcagattcttaggtataaatcaaggtgttacagaaagtaaatactcatcc

SEQ ID NO: 15863 - RNA, 149 nt, unidentified
  source 1..149: mol_type = other RNA; note = Related to NZ_JACIEP010000005.1; note = Dysgonomonas hofstadii
ggatgagctaaagatttagcaagaaagaggtgtagtcgcctcgatagttcatgccttttctgagatttaggattgttctgtattactgcctaaatctttcagatttacaggcggtactacagaacaatcctaaaagtaaacacttgtcc

SEQ ID NO: 15864 - RNA, 149 nt, unidentified
  source 1..149: mol_type = other RNA; note = Related to JACMIC010000003.1; note = Dysgonomonas sp.
ggatgagataaagatttagcaagaaagaggtgtagtcgcctcattgattcatgcctattctgagattcagtaatactttgattttattacctgaacctttcagattcatggtataaaatcaaagtattactgaaagtaaatgctcatcc

SEQ ID NO: 15865 - RNA, 144 nt, unidentified
  source 1..144: mol_type = other RNA; note = Related to QVMQ01000008.1; note = Dysgonomonas sp.
gggtataaagatttagcaagaaaggggtgcattcgccccgcaaaatcatgtattttccgagatttagataaatgcctaaagctaatattctaaatcctccggaatttattcatgctttaggcatttatctaaaagtaaactccc

SEQ ID NO: 15866 - RNA, 149 nt, unidentified
  source 1..149: mol_type = other RNA; note = Related to QVMN01000003.1; note = Dysgonomonas sp.
ggatgagctaaagatttagcaaaagaagaggtgtattcgcctcatacactcatgttctttctggggatttaggcgtaattgtatgttatgtgctaaatcttacagattatagataacatacaattatgcctaatagtaaacactcatcc

SEQ ID NO: 15867 - RNA, 215 nt, unidentified
  source 1..215: mol_type = other RNA; note = Related to JAFPFX010000010.1; note = Prevotella sp.
gtgcaatgaacttcagcattgtagagatgaagtcgtctcccaaactaacagttgttttaccctttattatgcgcaaggcataataaagattacctctaggctttcgtgtctccttcgccactgaaaggcgaagtgtcgccttcccgcgtctcgtgtccccaaaagcctagaggtgattattgctctgtcttacgcttaagtgaagttcattgcac

SEQ ID NO: 15868 - RNA, 134 nt, unidentified
  source 1..134: mol_type = other RNA; note = Related to NZ_CP034930.1; note = Apibacter raozihei
tgagaatcaaaatttagcattagaggtgtattcgcctcgtttactgaggatatttagtagcaagtaaaaaagatacaaagtatctttatacttagttaagtattgataaacatatacttaagtaaatattctca

SEQ ID NO: 15869 - RNA, 190 nt, unidentified
  source 1..190: mol_type = other RNA; note = Related to PKRS01000005.1; note = Emticicia sp.
agatggggaaattagcatcacttggaggtgtaatcgcctcttgattaaatgcctacgttagccgttccctgtaactttagttacagggaagcagtttttcaaactgcttgtctaaatttatgctaaatttagacaacgaataaattgagttgtatcacattcaaaatacaaaaagtaattttcccattct

SEQ ID NO: 15870 - RNA, 170 nt, unidentified
  source 1..170: mol_type = other RNA; note = Related to QNTX01000003.1; note = Elizabethkingia miricola
agagtgaaagatttagcagattggaggtgaattcgcctcaggcatttaagttaattttaaaactacttaataaaactcattaagtaagttcttagcagaacttacctactaaattttactaacgtaaatttagtaaatagaataatacaatgaaagtaaatactcatcct

SEQ ID NO: 15871 - RNA, 168 nt, unidentified
  source 1..168: mol_type = other RNA; note = Related to MAUH01000030.1; note = Chryseobacterium sp.
aggtgaataaaattttagcagattggaggtgtagtcgcctcaggcttaaacggtagtttaatctacattagtaaactaataagttcttaacagaacttgttactaaatattactttggtaaatttagtaatgagaattacattacatagaaagtaaataaaaacacct

SEQ ID NO: 15872 - RNA, 169 nt, unidentified
  source 1..169: mol_type = other RNA; note = Related to JADEYP010000027.1; note = Sphingobacterium sp.
agggcagaaaaattagcaatacagagtttagatgtcgactcttttgattaggctgtaattagcctaacataaattatctgaaaagagaatttatgttggtaccttaacaggataccagttctattattagtaatagaactaagataaatatatagaaagtaattgccct

SEQ ID NO: 15873 - RNA, 177 nt, unidentified
  source 1..177: mol_type = other RNA; note = Related to QUMF01000012.1; note = Odoribacter sp.
ggatggagaatgaaactagcacgtcgaggtgcattcgcctctttgattaacgctattgttagccaaggtagtataacgggtactatcttagttcctaacggaactaagatactaaattctactaacgtagaagtttagtatcgagaataaatttcaatgaaagtagtttctccatcc

SEQ ID NO: 15874 - RNA, 178 nt, unidentified
  source 1..178: mol_type = other RNA; note = Related to NZ_ANLA01000010.1; note = Xanthomarina gelatinilytica
ggatggggaatgaaactagcacgttggaggtgtattcgcctcttagattaacgctggcgttaaccatactagtgccttaaaaggcactagtatagttcctaacggaactatactactaaatctacttcgtagtatttagcagttagaataaattacaatgaaagtagttttcccatcc

SEQ ID NO: 15875 - RNA, 177 nt, Pseudomonas fluorescens
  source 1..177: mol_type = other RNA; note = Related to LCYB01000004.1
tggggtcggctctagtaatcgaaggtgtatccgcctttatcattcaggctgattttagccacgaatgaattcaactctatcgctccactcgcttcgctcgctcctcgatagagttaaatccattcactacgtgaatgaatttaagtgaaaagagcaagctggtagggtcggccttca

SEQ ID NO: 15876 - RNA, 161 nt, Pseudomonas sp.
  source 1..161: mol_type = other RNA; note = Related to CP027736.1; note = Pseudomonas chlororaphis
tggggtcggctctagtaatcgaaggtgtatccgcctttatcattcaggctggttttagccactgaatgaattcaactctattgcttcgcaatagagttaaatccattcactgacgtgaatgaatttaagtgaaaagagcaagctggtagggccgaccttca

SEQ ID NO: 15877 - RNA, 161 nt, Pseudomonas sp.
  source 1..161: mol_type = other RNA; note = Related to NZ_QDGR01000012.1; note = Pseudomonas aeruginosa
tggggtcggctctagcaatcgaaggtgcatccgcctttatcattcaggctgcttttagccactgactgcgttgaactcaagcgcttcgcgctcaagttaaacgcattcactgacgtgaatgagtttatgtgaaaagagcaagttggtagggccggccttca

SEQ ID NO: 15878 - RNA, 156 nt, Pseudomonas sp.
  source 1..156: mol_type = other RNA; note = Related to NZ_CP067098.1
agggggtcggctctagcaatcgaaggtgttttcgccttcatcgttcaggctggttttagccactgaatgaaataaactctgctgcgcagagtgcatttcattcactgacgtgaatgaaatatcgtgataaaagcaagctcgtagagtcgatcccct

SEQ ID NO: 15879 - RNA, 162 nt, Pseudomonas sp.
  source 1..162: mol_type = other RNA; note = Related to NZ_CP077094.1; note = Pseudomonas promysalinigenes
tgggtccggctctagcaatataaggtgtagtcgcctttatcgttcaggctggttttagccactgaatgaattcaactctaccgctagcgcggcagagtctaatccattcactgacgtgaatgaattagagtgaaaacagcaagctagtagagtcgggcctca

SEQ ID NO: 15880 - RNA, 164 nt, Achromobacter sp.
  source 1..164: mol_type = other RNA; note = Related to CYTI01000008.1; note = Achromobacter xylosoxidans
cgtgtttgagcgttagcaatcgggggtgcattcgccctcattcggtaaggctgcttttagccactgaacagaaaaactcttcttcctacggaagaagagttctttccattcactgacgtgaatagaaagaagtgataaataatggttagtaacactcaaatgcg

SEQ ID NO: 15881 - RNA, 161 nt, unidentified
  source 1..161: mol_type = other RNA; note = Related to JAIZSD010000010.1; note = Burkholderia seminalis
cgggcttgagcgctagcaatcggaggtgcattcgcctctatcgataaggctgcttttagccactaaatgtataaaactctgcttcttcgaagcagagtttcatccattcactgacgttcctggatgaagtgaaaacgcatggtacgtagcgctcaggctcg

SEQ ID NO: 15882 - RNA, 165 nt, unidentified
  source 1..165: mol_type = other RNA; note = Related to NZ_WKJJ01000010.1; note = Massilia rivuli
cggcttgagcattagcaatctgaggtgttatcgcctctctcgttaaggctgcttttagccactgaatggatcatactctgcttcgacaagtcgaagcagagtacaattcattcactgacgtgaataaattgtgtgaaaaagtacggttcgtaatgctcaagctcg

SEQ ID NO: 15883 - RNA, 158 nt, unidentified
  source 1..158: mol_type = other RNA; note = Related to NZ_CAIGKG010000003.1; note = Cupriavidus necator
gggttttcagcgttagcaatcgaaggtgtcatcgccttcatcgtttaggctggttttagccactaaatgaatttactctgcttctgcgaagcagagtaaatccattcactgacgtgaatgtatttccgtgaaaactgcaggctcgtaacgctgaatcc

SEQ ID NO: 15884 - RNA, 169 nt, unidentified
  source 1..169: mol_type = other RNA; note = Related to NZ_RBXP01000016.1; note = Azonexus fungiphilus
tggagtctagtgttagcaatcgaaggtgttatcgcctttatcattcaggccgcttttagccactgaatgaatgctgactctgattctgcaagcagaatcagagtcacaattcattcactgacgtgaatgaattatcgtgaaaaatgacagttagtaacactagattcca

SEQ ID NO: 15885 - RNA, 179 nt, unidentified
  source 1..179: mol_type = other RNA; note = Related to CP014943.1; note = Colwellia sp.
tgaggttttgctctagcaatataaggtgtattcgcctttttcgattaggggttgtttaaccactaataggtctgatcacttaagaacgaataaaagacactattcgctcttaagtgatgagaattatcactacgtgacaatgtctcaaagtgaaaattttatagtagagcaggacctca

SEQ ID NO: 15886 - RNA, 188 nt, unidentified
  source 1..188: mol_type = other RNA; note = Related to NZ_FYAJ01000004.1; note = Photobacterium andalusiense
tgccttctagttctagcaatataaggtgtattcgcctttttcggttaggttaactttaacctaatcgaattataagagcctgcaccaagattcgaacggtggagctttgttcgaatcttggtgcacataacttccactacgtgtaaggttatgtattagaaaaagatagaaagtagaactagaaggca

SEQ ID NO: 15887 - RNA, 175 nt, Aeromonas hydrophila
  source 1..175: mol_type = other RNA; note = Related to NZ_CP028568.2
atgtgagaggggctagcattttgaggtgtcatcgcctctattgctcaggttaattttagccatcgagcaagtctaaactatgcacgcatcgaaaagactgatgcgcgcatagttcaaaattgatcactgacgtgatctattttggatgaaaatacagtaggtagcccctctccat

SEQ ID NO: 15888 - RNA, 172 nt, Aeromonas sp.
  source 1..172: mol_type = other RNA; note = Related to NZ_JRBG01000001.1; note = Aeromonas media
tagcgagaggggctagcaatatgaggtgttatcgcctctatcgttcaggctatttttagccactgaacaaaccactgcacgcacatcgaaaagatgatgcgcgtgcagtgaagtttgttaactgtcgttaacaaacttcgagtgaaatatcagttagtagcccctctcactt

SEQ ID NO: 15889 - RNA, 176 nt, unidentified
  source 1..176: mol_type = other RNA; note = Related to JAIUIU010000040.1; note = Mesorhizobium sp.
tggccgccccggttaggacgatgaggtgttacgcctcgggactaaaggtgtctttatcatctctgcgagggctaacgcccatcgctaatgagccctaacaggctcattgccatgtcgctaacgcgcatggatgaaatacaaatatgtataatgatgaatagtaatcgaggcggtca

SEQ ID NO: 15890 - RNA, 173 nt, unidentified
  source 1..173: mol_type = other RNA; note = Related to SJST01000002.1; note = Oricola cellulosilytica
atgcctcgctcgatagcacttaggggtgcactcgcccctcagtctcacgggggatttagcactttggacctgctacaatcaggtcccacagggctacgcccttgtgtcgggaaaccgcaaagcggttgtcccaaaaagaagatgaactttcttgattgtatcgggcggggcag

SEQ ID NO: 15891 - RNA, 174 nt, unidentified
  source 1..174: mol_type = other RNA; note = Related to JAEPPB010000039.1; note = Pseudomonadales bacterium
agggggctcccaatagtattaggagatgttttcgtctccatttcgataaggctagctttagcggacacactggcgtgtaaacacgccagtaacctggaaaacggttagtattttgtgtcattaacatgacttttattactgtgtcataaaagaagaaagtattgggagtcccct

SEQ ID NO: 15892 - RNA, 171 nt, unidentified
  source 1..171: mol_type = other RNA; note = Related to NZ_CAKLOR010000001.1; note = Klebsiella variicola
tggctgcatacgctagattatgaaggtgaattcgccttttatgcttaggctacctttaacctgttaatggttaaaggccactacaacgttcttcgaacgttgtagtgaacattaatcattaacatgattaatgttgagcagaaacaaaaccgttagtagcgtatgcagtct

SEQ ID NO: 15893 - RNA, 107 nt, unidentified
  source 1..107: mol_type = other RNA; note = Related to SLYT01000019.1; note = Rahnella sp.
tgctgtccagctctagtttaataggtgtatcgcctatggatgctaaggttttctttaacctcacgagttctgcattttttcttttgattcggtagtgctggacagca

SEQ ID NO: 15894 - RNA, 104 nt, unidentified
  source 1..104: mol_type = other RNA; note = Related to NC_010334.1; note = Shewanella halifaxensis
ggctatccagcgttagttagtataggtgaatcgcctatcttgttgaggtcctttttaacctcatcaattctattacaagctccggttcgtggcgttgggtagcc

SEQ ID NO: 15895 - RNA, 101 nt, Vibrio sp.
  source 1..101: mol_type = other RNA; note = Related to NZ_MCYY01000073.1; note = Vibrio breoganii
ggctatccagcgttagctagtataggtgaatcgcctatcatgtgaggttctttttaacctcataaattctattggccggcatattgttgcgctgggtagcc

SEQ ID NO: 15896 - RNA, 109 nt, Aeromonas sp.
  source 1..109: mol_type = other RNA; note = Related to JH823256.1; note = Aeromonas veronii
ggctgctcactgctagtgagtataggtgtatcgcctatcattatgttgaggtttattttaacctcattacattctaaaaagacgttgttgttcgtggcggtgagtagcc

SEQ ID NO: 15897 - RNA, 160 nt, Vibrio sp.
  source 1..160: mol_type = other RNA; note = Related to NZ_LNRB01000009.1
tggagctaagctcccatgggtgattcgcctatgtcgttaagggtttttttaacctcactacgttctattaaatatttaaaagactttcgtgatactgagtagctacctacttcttggagcaagatttgagtccagaatacaaaaagtggtttgagttcct

SEQ ID NO: 15898 - RNA, 174 nt, unidentified
  source 1..174: mol_type = other RNA; note = Related to JAAFZY010000006.1; note = Mangrovimonas sp.
ggagggaaaggattagaagatggagtgtagtcgctccagtaaagcttaggctgttttaaccattgtgatgatttgttagaactgaaacatgcaagggcagtttcagcgataataattcatctcaaatcgaatggaaaagatttatttcgaattattatgtaatcctttctctct

SEQ ID NO: 15899 - RNA, 183 nt, unidentified
  source 1..183: mol_type = other RNA; note = Related to FNSF01000001.1; note = Tenacibaculum sp.
tgagagagaggattagaaaataaggcgtagtcgccttagtaaggctcaggctgttttatccattgaaatgatttgttagcactgaaaatatttcgatatatttccagagataataaaacatctcaacatttgataaagtttcgagttttattgctttaaggattgtcgtaatcctctcttttt

SEQ ID NO: 15900 - RNA, 174 nt, unidentified
  source 1..174: mol_type = other RNA; note = Related to JAIQZE010000004.1; note = Psychroflexus sp.
agagaagaggaattagaaaatgaggcgatgtcgcctcagtacagttaaggctgttttatccattataatgatttgttagaactgaaatcagaaaattgattccagttacaataattcattatttgtaaagaatggatttctattttatgaattattgtgtaattcttcttctct

SEQ ID NO: 15901 - RNA, 178 nt, unidentified
  source 1..178: mol_type = other RNA; note = Related to BBMM01000006.1; note = Nonlabens ulvanivorans
gaaaagggagaattagaagatggagtgtaggcactccagtgcggcttaggctgttttatccatttgatgcattgctacaactgaaatcaagaaaaatgattccagttataaaaattcttcaatagtaatattgaagtatttagttttatatcgaatttttacgtaattctcccatttt

SEQ ID NO: 15902 - RNA, 178 nt, unidentified
  source 1..178: mol_type = other RNA; note = Related to JAHXPQ010000003.1; note = Mucilaginibacter sp.
aagagaatagtactagcgtttataagtcgtagcgacttttttaataaggctgatttaaacctcagtttttgtaccaaaaacaaatattctaacgaatattatttgaatgattcattccattgtatttcattcacattcaattagaattaatttcaatgatgtgtagtactattccttt

SEQ ID NO: 15903 - RNA, 168 nt, unidentified
  source 1..168: mol_type = other RNA; note = Related to JAGQWR010000133.1; note = Saprospiraceae bacterium
agaggagtaggtactagcaactttgaggcgatgtacgcctttatgattgacgctggcgttagccacggggtagcattttaactaatgctaccaattcttcgaattgaaaatcaccggagttgattttatcagaatctatgattaatagaatagtagtacctctcctct

SEQ ID NO: 15904 - RNA, 193 nt, unidentified
  source 1..193: mol_type = other RNA; note = Related to JAGNNE010000423.1; note = Leptospiraceae bacterium
agcttgtagctagttgtatgagatgttatcgtctcagggatttaggccgagtttagcccattttgtggttgcataaaagaactgatttttatgcaaccacaaatgctcctcggtagctgcatttgcatagttgctgcattaacatgcaataatatgcaaatgaagttcctttcagagaaggtagctacaagct

SEQ ID NO: 15905 - RNA, 236 nt, unidentified
  source 1..236: mol_type = other RNA; note = Related to CP027860.1; note = Ahniella affigens
cgaagtcggaaagctagacgttggagtgtcatcgctccctatgctgaggcgagcaatcgtctcagtcgacgtaccgggaaatcatcagtacgtcgactgcaaccagtttgtcaaaccttcggtttgccaacctggctgcaacaaagaagttcgctgtcaagcgtcccgcttgccatcgaacttctttgctgtgcgtgctttgcagcacgtaatagtattaagtagcaccggcttcg

SEQ ID NO: 15906 - RNA, 225 nt, unidentified
  source 1..225: mol_type = other RNA; note = Related to JAFIXE010000059.1; note = Stenotrophomonas maltophilia
ggcctggtcgcgcattagaagatggagtgtagtcgctctgtgtattgaggccattttcggcctcgctactgacgattttaacaaatcgtcagtatcaggcgccccttcgggtcgcctcagcgcgtagtcagcctgaccgtgcgcattcgcacgctcaggctgcctacacgccgagcgatagtacaaatgtactatcgtaaaagtgaagtaatgtgccggccggcc

SEQ ID NO: 15907 - RNA, 229 nt, unidentified
  source 1..229: mol_type = other RNA; note = Related to NZ_FNNB01000012.1; note = Sulfitobacter pontiacus
gagtggtcaccgctagcgtttagaagtgtagtcgcttctacggttaaggtgggcgaaagccttacagtaacatttcttgagtttctcaagaaagtgttactgtgcctccttgcgtcggcaggcccgaaatacgatgaaatttcaattttcaatgctgaaaatggaaattcatcgaatttcaggcgtaagcgatgcgagcatcgaagagatctggtagcggtggccacgc

SEQ ID NO: 15908 - RNA, 237 nt, unidentified
  source 1..237: mol_type = other RNA; note = Related to NZ_CP044970.1; note = Brucella anthropi
gagtggtcgcagttagcgcacggaagtgtaatcgcttctgcggttaaggctcacgatagccttgtggacactcgattttttgagtctctcaaaaaagtcgagcgtccaatgtctcctcatccgagggacagacacgtgaaccacagaaaccttcgtttttattcaaaaacaaaggttctgcgcttcacgtgtctaagcgatgtaaacatcggaatgatctggtagcggcgaccactc

SEQ ID NO: 15909 - RNA, 236 nt, unidentified
  source 1..236: mol_type = other RNA; note = Related to JACIDV010000004.1; note = Rhizobium skierniewicense
gaatggttgtcattagcgcaaagaagtggattcgcttctgcggttgaggttcgcgatagcctatcgactactcgatttttagagtgttctaaaaagtcgagtagtcgaaatgcgctctccgagcgcatcggcacgattgtcgcagaaactcgaattttcttagaaaatccgagttctgcgtcactcctgccgcagcgatgccttgcatcgaaatgattacgtaatggcaaccattc

SEQ ID NO: 15910 - RNA, 230 nt, unidentified
  source 1..230: mol_type = other RNA; note = Related to NZ_BACT01000550.1; note = Methylobacterium sp.
aggcggccgacgttagcgtttaggagtgtagtcgctcctacgggtaaggctggcgtaagccatcgccggggttcgatttggcgtcccgccaaagtcgccccccggtgtgtcaccctatcgggtgaccagcaatacagccaaaaaggccctgtgagactactcacagcgccttttgtctgcattgctgatgcgttgctcgcaacggattgatcaagtaacgtcggccgcct

SEQ ID NO: 15911 - RNA, 227 nt, unidentified
  source 1..227: mol_type = other RNA; note = Related to NZ_SKCI01000005.1; note = Marimonas lutisalis
ggctggcgctcggctagtgtttcgaagcgaagtcgcttcggcagctaaggctgagtttaacctccagcagggagattcgaactcgttccgacttcgcatctccctgcgggcagcgggttcatcttctttgaatctgaatccgcgccataacgacatcttgcagtcgcaagatgtcgttatggagcgtcttccagacggaagtgggaagtagtagtcgtgcgccggcc

SEQ ID NO: 15912 - RNA, 152 nt, unidentified
  source 1..152: mol_type = other RNA; note = Related to NZ_GL883080.1; note = Asticcacaulis biprosthecum
gggtggcgatagcactttgaggcgatctcgcctcgttggctaaggccaagtttatgcacaggtcaggacacgtcctgacctacgccccggtggggcgtagtatgccataaaggcatgttgtgaacgatgttgatgagaaggtatcgccaccc

SEQ ID NO: 15913 - RNA, 163 nt, unidentified
  source 1..163: mol_type = other RNA; note = Related to JAAXEP010000005.1; note = Rhizobium leguminosarum
aggcgggtggtgatagcacggtgaggcgacttcgcctcgttggctaaggccaggtttatgcactgggcaagactgcgctttgccctacgtccctgcggggacgaaacgatgccataaaggcatcgagtgaactacgttaatttgaaggtatcaccacccatca

SEQ ID NO: 15914 - RNA, 155 nt, unidentified
  source 1..155: mol_type = other RNA; note = Related to NZ_CAKLBS010000005.1; note = Sphingomonas sp.
gggtggcgatagcacgttgaggcgacctcgcctcgttggctaaggccagatttatgcacagggccttcttgcagaaggccctcgcaccctgcgggatgcgtgcgatgccataaaggcatcgagtgaactttgttgatttgaaggtatcgccaccc

SEQ ID NO: 15915 - RNA, 184 nt, unidentified
  source 1..184: mol_type = other RNA; note = Related to NZ_CP022528.1; note = Qipengyuania flava
gttagggcggcgatagtgtccagaggcggtttcgcctcgtttagttaggcttcgtttatgcatacattctccgcgcgaggcttacccgtcgcggagatcgtatccacacttcgtgaggatacgaagtcatacgcgagctagacttcatatgaacgtgttgatgcgaaggtatcgccgccctaat

SEQ ID NO: 15916 - RNA, 204 nt, unidentified
  source 1..204: mol_type = other RNA; note = Related to JAJTGN010000370.1; note = Roseomonas sp.
gggtcagctcgatagcataaagaggcgtagtcgcctctgtggtttaggctgacgttagacttgcgtaatgcacattcgtgcattacttatgcatctcaatcgatgcatatgcatctcaatcgatgcataaaatgcaaaattttgcaaaccgcaaaatttgcattgagggatggcttcgtagaaggtaaagtatcgttctgatcc

SEQ ID NO: 15917 - RNA, 165 nt, unidentified
  source 1..165: mol_type = other RNA; note = Related to NZ_JROG01000004.1; note = Sphingomonas sp.
gcgatggtgcggttagacttagaggtgggttcgcctcggttgctaagggttccgttagatgctcggcgatcattcgatcaccgatgagcacctacggcgctcatagaactacataatatagtagttctagcaaattatcatgacggatagtatccgcaccatcgc

SEQ ID NO: 15918 - RNA, 165 nt, unidentified
  source 1..165: mol_type = other RNA; note = Related to NZ_BEWP01000006.1; note = Gluconobacter kondonii
gcgatggtgtggttagacaaagaggcgggttcgcctcggttgcaaagggcttcgttaggcgctcggtaatcgttcgattaccgaaacgcgctttcagcgctcttagaactacatataatagtagttctagcaaatctctatgatcgatagtatccgcaccatcgc

SEQ ID NO: 15919 - RNA, 173 nt, unidentified
  source 1..173: mol_type = other RNA; note = Related to JAHVKP010000001.1; note = Qipengyuania aquimaris
agcggctcatcggttagacatagaggcggcttcgcctcggttattaacggttccgttagatactaggctttccttcgcaaagcctatgagcactttcagtgctcatgaaattacatatataaatatagtaaatttcagttaattatatgactgatagtatccgatcagccgct

SEQ ID NO: 15920 - RNA, 176 nt, unidentified
  source 1..176: mol_type = other RNA; note = Related to NZ_PHSN01000004.1; note = Acidimangrovimonas sediminis
gggcgggcatggatagaacttagaggcgcattcgcctcggttgttcaggctgactttaaggcagcctccctcaagagggaggctgttgttcctgcggaacaacacggtgcccatgaagggcaccatgcagatatcatattttagatatgatataaattattaggtatcctccgtcc

SEQ ID NO: 15921 - RNA, 172 nt, unidentified
  source 1..172: mol_type = other RNA; note = Related to SJNG01000007.1; note = Rhizobium leguminosarum
cggggcgcagcgatagttcttgggggtagattcgcccctgcaagcttaggagcgcgttaaattttcttcacgcacttcgcgcaagaagcatagatcctttggatctatgtttactgcataaagcagtaacgaagaatatatactatattcactctggtatcgttgcgctcca

SEQ ID NO: 15922 - RNA, 128 nt, unidentified
  source 1..128: mol_type = other RNA; note = Related to LMCG01000027.1; note = Pseudovibrio sp.
agcaggatctgcgatagtatgtggcgcagtcgccacatcaactcaggggcccgttaacgttcctataaattaattttataggaatttggtttttgatatgattatttatggtatcgcagtttcctgct

SEQ ID NO: 15923 - RNA, 178 nt, unidentified
  source 1..178: mol_type = other RNA; note = Related to VFTI01000007.1; note = Mesorhizobium sp.
ggcatcaaggaactagcgcaacgaggtgaattcgcctcggcgacttaggctagagttaagcccattcggtaatcgaagaagattaccgagaggttctacgaacctcagacaactaacattgttatttgtcgatgaagcagtcgaaatataaatctgtattatgtggtgacttggtgcc

SEQ ID NO: 15924 - RNA, 177 nt, unidentified
  source 1..177: mol_type = other RNA; note = Related to NZ_AYXE01000006.1; note = Mesorhizobium sp.
ggcatcgggaagccagcgcaacgaggtgcaatcgcctcggcgacttaggctaaggttaggcccattcggcaatcgaagagattaccgagaggttctacgaacctcagacaagtaacatggttatttgtcgatgaattagttgattggtacaatcatattatgtggtaacccggtgcc

SEQ ID NO: 15925 - RNA, 172 nt, unidentified
  source 1..172: mol_type = other RNA; note = Related to LR701476.1; note = Roseovarius sp.
tgaaggctcggcgatagtaacgggaggtgtatccgcctccgtcttgttaaggtgtgcgttagattatcttcacgcgccttgcgcaagaagcatgggatctaaagatcccatgttactgcataaagcagtaatgatatcatgaagtatgatttctttgtatcgctgaccttct

SEQ ID NO: 15926 - RNA, 214 nt, unidentified
  source 1..214: mol_type = other RNA; note = Candidatus Blautia pullistercoris; note = Related to DXFG01000149.1
agaccggggacagcatatgcagaaaattttcttgcaggaaatgttctgcggcagaagcgagtcgcttttgctttgatcttttccgggtatgatggcacagccagcccttcatcagctcttgtgtacatccgcacacttcatgtgcataaataagccttcggcttattggtacacagccgctgcttacggtatcaccattttgtgttcccggtcc

SEQ ID NO: 15927 - RNA, 218 nt, unidentified
  source 1..218: mol_type = other RNA; note = Candidatus Blautia stercoripullorum; note = Related to DWUX01000243.1
agactggggacagcatacgcagaaaatattctcccttacaagatgatttctgcggcagaagcgagtcgcttttgctttaatcttttccgggtattatggcacagccagcccttcatcagctcttgtgtacatccgcacacttcatgtgcataaataagccttcggcttattggtacacagccgctgcttacagtatcaccatttcgtgtccccggtcc

SEQ ID NO: 15928 - RNA, 193 nt, unidentified
  source 1..193: mol_type = other RNA; note = Related to DXBG01000050.1; note = Candidatus Blautia pullicola
tttcgggaaacagcttacgcagattttctgcccccaaggcgagtcgcctccgggtatttattccagggttttctggctctgccagcccttcatcagctcttgtgtacaaccgcacatttcatgtgcctgccaagccttcggcttgtggtacacagccgctgcttacggtatcaccattttgtgtttcccgaac

SEQ ID NO: 15929 - RNA, 189 nt, unidentified
  source 1..189: mol_type = other RNA; note = Lachnospiraceae bacterium; note = Related to JAGZGI010000008.1
tcacagcagacagaggagacagttttctgtcagagaagcgagtcgcttttctattttttattccgaaaggtatggctgcgccagccctccttcggctccgaggtacatctgcacactgcatgtgctttctcgcctgcggcgccgtacctcttcgccgaatccggtatcaccatttagtgtctgctgtgt

SEQ ID NO: 15930 - RNA, 189 nt, unidentified
  source 1..189: mol_type = other RNA; note = Related to NZ_CP030280.1; note = Blautia argi
acacagcagacagcgaggacagatttctgtcagagaagcgagtcgcttttctattttttcaataaaaggaatggctttgccagcccttctttggcttcgaggtacatctgcacatttcatgtgctttgcccgcctgcggcgcagtacctcttcgccaaatccggtatcaccattttgtgtctgctgtgt

SEQ ID NO: 15931 - RNA, 192 nt, unidentified
  source 1..192: mol_type = other RNA; note = Related to CP022413.2; note = Blautia hansenii
acgcagcagacagcgaagacaacgaaaaacttcatgtcagaaaagcgagtcgcttttctatgttataaattaagcgatggcttatgccagctctgcattggctacgccgtacatcggcacatttcatgtgcttttgcctgcggcttgtacggcttcgccaatttctttatcaccattttgtgtctgctgtgt

SEQ ID NO: 15932 - RNA, 198 nt, unidentified
  source 1..198: mol_type = other RNA; note = Candidatus Egerieimonas faecigallinarum; note = Related to DVGS01000147.1
cgcagaaggacagcgttcacaggttgtttctgtgggggaagcgagtcgctttcctgaatttcttttccggcgggacggcttcgcccgccctgcgtcagctccgatgtaccgcgggcatggagatgcccgcgtccagccttccagctggttctgcacatctgcgctgtctccggtatcatctctttgtgtccttctgcg

SEQ ID NO: 15933 - RNA, 194 nt, unidentified
  source 1..194: mol_type = other RNA; note = Candidatus Mediterraneibacter vanvlietii; note = Related to DXGZ01000117.1
agaccggggacagcgcatgtgaaatctgtttcaccggggaagcgagtcgctttcctgattctctgatctgcaggtacggcgtggccgtcccttacaccgctcctgtgtacttctgcacactgcgtgtgctttcgtgcctgcggcacgcgtacacatccgcgggatgcggtatcatcattttgtgtccccggttt

SEQ ID NO: 15934 - RNA, 195 nt, unidentified
  source 1..195: mol_type = other RNA; note = Candidatus Mediterraneibacter colneyensis; note = Related to DXEY01000047.1
ataccggggacagcggtatgcggaacggttccgcacagggaagcgagtcgctttcctgctattttctgttgcgttatgatggcacagccatccctccatctgctccgatgtactaccgcacacggcgtgtgcatgtgccttcggcacgggtacacctccgcagattacggtatcaccatatagtgtccccggtaa

SEQ ID NO: 15935 - RNA, 199 nt, unidentified
  source 1..199: mol_type = other RNA; note = Proposed Lachnoclostridium sp.; note = Related to NFKT01000023.1
ataccgggaacagcttactgcagaaaccagacttttccgcagggggaggcgagtcgccttcctgttatttttatccggtgaaacggcactgccgtccctccgccgctcctgtgtactactgcacacttccatgtgcatgcgcctgcggcgccggtacacatccgcggattacggtatcaccatattgtgttcccggttt

SEQ ID NO: 15936 - RNA, 219 nt, unidentified
  source 1..219: mol_type = other RNA; note = Related to JAJEQX010000005.1; note = Ruminococcus sp.
agaccggggacagcgaagcgcggatactgagcgacgccagtacagaacgcgcaggggaagcgagtcgctttcccttctgacatttacccgggtgatcatggctctgccatccctgcacccgcttctgtgtactgctgcacactttcatgtgcctggccgtgcctgcggcactggtacacatacgcgggttccggtatcaccatatcgtgtccccggttc

SEQ ID NO: 15937 - RNA, 210 nt, unidentified
  source 1..210: mol_type = other RNA; note = Related to JAGTTS010000004.1; note = Clostridiaceae bacterium Marseille-Q3526
cggcagacggcagcgaaaaagcgtttcatacaggctttttggaagagcgagtcgctcttcctgtggataaaaagaggacaggcagcttcgcagccttccgaatctccttcgccgtacatggtttccggtttccggaaactcctatcctcttcgaggatatggggtacggctttggaagaaccggcattgccgttttagtgctgtctgccg

SEQ ID NO: 15938 - RNA, 210 nt, unidentified
  source 1..210: mol_type = other RNA; note = Related to NZ_CP085988.1; note = Clostridium sp.
aggcgcgcggcagcgaatggaacataagggttcccaaaggagcgagtcgctctttttgtcagaagggaggggcaggcagcgctgtctgccttccaaatcatctgcaccgtacagggagcgcccatgcggtgcatgaacgccggtatcccctgcggggatattcagtacggctccgaagattcggcattgctgtgacagtgccgcccgcct

SEQ ID NO: 15939 - RNA, 252 nt, unidentified
  source 1..252: mol_type = other RNA; note = Clostridiales bacterium; note = Related to JAGZWN010000002.1
ccccggacagcggaaagcgggaaatggacggaacgccctcttcgggggcggctcctgaaaaaactgcgggaaatgcgagtcgcatttctgagaaagaagaaagcaccggcagacacggtctgcatgacaatggaacttccttccattgtcataaaaaacggctgcagcgtacgactgcacaccttgcggtgtgccaggccgccgtcggctggcacgcctccgccgttttgtatcacagtattgtgtccggga

SEQ ID NO: 15940 - RNA, 185 nt, unidentified
  source 1..185: mol_type = other RNA; note = Related to HF995414.1; note = Firmicutes bacterium CAG:646
tgaaacaggatagcgtaagcagagagatctgcggggaaaacgagtcgttttcctgaaagagtaggagagataaccggctttgccggccggaattacgccaaggtacgactgcacactagggtgtgcttacagccttcggctttgtacctttctgtaattccctatcacgatttagtatcctgtca

SEQ ID NO: 15941 - RNA, 195 nt, unidentified
  source 1..195: mol_type = other RNA; note = Related to DXHY01000007.1; note = Candidatus Eisenbergiella stercoravium
aaccggaaagcagcgttgctgctggcagaaccggcccggcagcgagtcgccgtcgggagagaatatcaggaggcggcaggcatgcctgcaccgcagcctgcttcgaggtacatctcacaacccgcttcgcggattgtgtctccgccttcggctgtacccctgcgcattctgcagaatcagagtattgtgtcggac

SEQ ID NO: 15942 - RNA, 215 nt, unidentified
  source 1..215: mol_type = other RNA; note = Candidatus Eisenbergiella stercorigallinarum; note = Related to DWUW01000200.1
gcccgttcgacagagaaaccggaaagcagcattgctgctggcagaaccggcccggcggcgagtcgccgtcgggacagaatatcaggaggcggcaggcatgcctgcaccgcagcctgcttcgaggtacatttcacaacccgcttcgcggattgtgttgccgccgtcggctgtacccctgcgcattctgcggaatcagagtattgtgtcggccgggc

SEQ ID NO: 15943 - RNA, 219 nt, unidentified
  source 1..219: mol_type = other RNA; note = Candidatus Eisenbergiella pullistercoris; note = Related to DXDD01000050.1
cccctgccggcagggaaaccggaggcagccgtcagggctgcgcacagcttcggaccggcggcgagtcgccgccgggagacaggatcgggagaaggcaggatggcctgcaccgcagcctgctccagggtacaacgcacaattccgcttcgcggattgtgtcgccgctttcggctgtacccctgcgcattctgcggaatcagcgtattgtgccggaagggg

SEQ ID NO: 15944 - RNA, 196 nt, unidentified
  source 1..196: mol_type = other RNA; note = Candidatus Eisenbergiella merdavium; note = Related to DWWS01000044.1
ccggaagcgtcagcgtgtctgaatgcaaagaccggcccggcggcgagtcgccgccgggaaagatcatcaggaggcggcaggcatgcctgcaccgcagcctgcttcaaggtacgtcgcacaatccgcagagcggattgtgtcagccgccttcggctgtacccttacgcattctgcggaatcggagtatcgtgtcggg

SEQ ID NO: 15945 - RNA, 216 nt, unidentified
  source 1..216: mol_type = other RNA; note = Related to DWWH01000066.1; note = Candidatus Eisenbergiella intestinipullorum
gcccgcccggcagaaaaaccggaaacagacggctcggaaagcgtctttcggaccggcggcgagtcgccgccgggacagatcaatatcaggcggcaggcgcgcctgcaccacagcctgcttcagggtacatctcacaacccgcttcgcggattgtgcagccgccttcggctgtacccctgcgcattctgcggaatcagaacaaggtgccggacgggt

SEQ ID NO: 15946 - RNA, 198 nt, unidentified
  source 1..198: mol_type = other RNA; note = Related to AP025576.1; note = Lachnospiraceae bacterium
acccggctgacagcatatccggaaactggagttttccggcctgacggggagtccccgccgggaaaaacagacagccaggacgcaggtgccctgcgaccgcaagctgttccaaagtacatcagcacactcccgtgtgcacaccgcctgcggctgtacatttccacagcttacggaatcggtgtattgtgtcagccggtg

SEQ ID NO: 15947 - RNA, 198 nt, unidentified
  source 1..198: mol_type = other RNA; note = Related to NZ_MCGI01000005.1; note = Eisenbergiella tayi
atccggctgacagcatattcggaaaattaattttccggcctgacggggagtccccgccgggaagaacaggctgcgcggacgcaggtttcctgcgaccgcaagctgctccaaggtacatcagcacactttacgtgtgcacaccgccttcggctgtacatttccgcagcttacggaatcggtgtattgtgtcggccggat

SEQ ID NO: 15948 - RNA, 209 nt, unidentified
  source 1..209: mol_type = other RNA; note = Related to NZ_QVLV01000005.1; note = Eisenbergiella sp.
agccggccggcagcatatccgggagaatattttccggcctgacggggagtccccgccgggagttagaaacagtgggcatgcagaatactgcatgcagaatcctgcacccgtaatccgctccaaagtacatccgcacacttccgtgtgcacaccgccttcggctgtacatttccgcagcttacggtatcggtgtattgtgccgtccggct

SEQ ID NO: 15949 - RNA, 215 nt, unidentified
  source 1..215: mol_type = other RNA; note = Related to RAYB01000053.1; note = bacterium 1XD21-70
aagacggcagcagatgaatcagcacttttttgcatggagacaggccaggaagggctggacgggcgccgagtcggcacccggtacagaaaatgccaggaaagcccacagcctgccctaaggtacagccgcacctttcaggtgcatcccgccgtttgcaccggcgtttggtacctatgcgcagtctgcggaatccctatataaagtgctgccgtttt

SEQ ID NO: 15950 - RNA, 216 nt, unidentified
  source 1..216: mol_type = other RNA; note = bacterium D16-56; note = Related to RAYY01000002.1
aaagcagccgcagacaagccagggtatttgatggatgagattcagacatcaacagactttgggcggacggcgagtcgccgcccggaaaaaacagtgacaggaaagtccgcagccagctccaaggtacatccgcacattacatgtgcttcgcgccggcttcaccggcgtatggtacctttgcgcagcctgcggtatccgaatgagtgcggctgcttt

SEQ ID NO: 15951 - RNA, 196 nt, unidentified
  source 1..196: mol_type = other RNA; note = Related to CP069520.1; note = Enterocloster bolteae
ggaaaagcaacagcattttcaggaatattgcataggcagtaagcctggacggacagcgagtcgctgcccggagtgaatagcagagggataagtccgcaagctgcgccgtggtacatccgcacatttcatgtgcccgccgctttgcggcccggtacccctatgcatcttacggtatccggatacgtgttgcttctcc

SEQ ID NO: 15952 - RNA, 195 nt, unidentified
  source 1..195: mol_type = other RNA; note = Related to JAKNTH010000001.1; note = Enterocloster sp.
ggaaaagcaacagcattttcaggaatattgcatgggcagtgagcctggacggacagcgagtcgctgcccggagtgaacagcagagggatgagtccgcaatctgcgccggggtacatccgcacatttcatgtgccggccgccagcggcccggtacccctatgcatcttacggtatccggatacgtgttgcttctcc

SEQ ID NO: 15953 - RNA, 183 nt, unidentified
  source 1..183: mol_type = other RNA; note = Related to DWYS01000122.1; note = Candidatus Enterocloster faecavium
cgggcgttggcagcgaaatcagagcaatgctttgggcgggcggcgagtcgccgtccggagtgggagaactcagggatcagcccccaggcagctacgatgtacggccgcacatttcatgtgcataaagcctgcggctttgtacatctgcgcttcctggtctatccctgtcagtgctgacgccca

SEQ ID NO: 15954 - RNA, 183 nt, unidentified
  source 1..183: mol_type = other RNA; note = Related to DWWB01000077.1; note = Candidatus Enterocloster excrementigallinarum
tctgcggcagcagcgaaatcaaagcggtgctttgggcgggcggcgattcgccgtctggagtaggaaattgaggggatcagcccgcaggcagctgcgatgtacggcagcacatttcatgtgcataaagcctgcggctttgtacatctgcgcagcctgcgctatccttgtttgtgctgccgccca

SEQ ID NO: 15955 - RNA, 205 nt, unidentified
  source 1..205: mol_type = other RNA; note = Related to JAJCIC010000013.1; note = Lacrimispora sp.
ctttatgcagcagcgaagccggttaagccaggagaaattgtaccggaatgaccggacggacggcgagtcgccgcccggaagaaaatagtaatgggacagaccgtaatcagctccgaggtacatcagcacatttcatgtgctatgctgctgacgcagcttgtacatctgcgcagcttacggtatcgggaatcagtgctgcgggctg

SEQ ID NO: 15956 - RNA, 180 nt, unidentified
  source 1..180: mol_type = other RNA; note = Candidatus Enterocloster excrementipullorum; note = Related to DWWT01000008.1
caaaagcagcagcccagccggaagaatcctttcggacgggcggcgagccgccgcctggaatttttttgttgtgacacagtccgcaagctgctccgatgtacttctgcacactgcatgtgcccggcctgcggcccggtacacctttgcagcttacggtatccgtaaacgtgctggattttg

SEQ ID NO: 15957 - RNA, 183 nt, unidentified
  source 1..183: mol_type = other RNA; note = Related to NZ_PGET01000001.1; note = Clostridium celerecrescens
gcagaagcaatagtatttccgcatgtaatgatcctgcggccgggcagcgagtcgctgccgggaatttcatggtttaggcaaaggccataatctgctgcgaggtactaccgcacattgcatgtgcctgcgcctgcggcttgtacatcttcgcatcttacggcatcatgtttgtattgcttctgt

SEQ ID NO: 15958 - RNA, 276 nt, unidentified
  source 1..276: mol_type = other RNA; note = Related to NZ_AZUI01000001.1; note = Clostridium indolis
gcagaagcaatagtatttccgcgagaaatgggccaaaggaatatgatgtatatacgtttggcccatgccgcggcagctgagaaaaacctgcatagcgtgtttttctcagctgccggcagaataaatctccggccgggcagcgagtcgctgccgggattttcatggtatggaaaaaggccgtaatctgctgcgaagtacttccgcacattgcatgtgcttccgcctgcggcttgtacgtcttcgcatcttacggcatcaaatttgtattgcttctgt

SEQ ID NO: 15959 - RNA, 191 nt, unidentified
  source 1..191: mol_type = other RNA; note = Related to NZ_JHWJ01000001.1; note = Clostridium aerotolerans
gcagaagcaatagtttttccggattaagtattcggccgggcagcgagtcgctgtccggatcatcataggatcataatagaccgcaagctgctgcgaagtaccaccgcacattgcatgtgcatgcgcatgtgcgggacacatgcgtgcgtacgtcttcgcatcttacggtatcattttagtattgcttctgc

SEQ ID NO: 15960 - RNA, 188 nt, unidentified
  source 1..188: mol_type = other RNA; note = Related to NZ_MCIA01000032.1; note = Lacrimispora algidixylanolytica
gcagaagttatagtttttccggtaaaactgccggctgggcagcgagtcgttgttcggattatcatagggttacaatagaccgcaatctgctgcgaagtacttccgcacattgcatgtgcatacgcatgtgcaagacatgcgcgcgtacatcttcgcatcttacggtatcattttagtattgcttctgc

SEQ ID NO: 15961 - RNA, 190 nt, unidentified
  source 1..190: mol_type = other RNA; note = Related to NZ_QJKD01000014.1; note = Hungatella effluvii
cagggaatcatagcttttccggaaccataaaggagatccggccgggcagcgagccgctgtcaggaatgtcatttttttaaggtcaaaagaccgtaatctgctccgaagtacatccgcacatttcatgtgcttacgcctgcggcttgtacatcttcgcatcttacggcatcctttttcgtatgatttcctg

SEQ ID NO: 15962 - RNA, 189 nt, unidentified
  source 1..189: mol_type = other RNA; note = Related to NZ_WNME01000006.1; note = Hungatella hathewayi
cggagattcatagcatttccagtattgcttagaggctccggccgggcagcgagtcgttgtccggaagttcacaagttaaggtcataagaccgtaatctgctccgaagtacaactgcacatttcatgtgcttacgcctgcggcttgtacgtcttcgcatcttacggcatcctttttcgtatgagtttcca

SEQ ID NO: 15963 - RNA, 188 nt, unidentified
  source 1..188: mol_type = other RNA; note = Related to NZ_QSGP01000002.1; note = Enterocloster aldenensis
agtggaatgatagcatttccggaatcctgagcggatccggccgggcagcgagtcgctgtcaggaacatcatgatagtaaggccgaaagaccgtaatctgctccaatgtacaaccgcacattccatgtgcacacgcctgcggcttgtacatctgcgcatcttacggaatccccttttgtatcatccact

SEQ ID NO: 15964 - RNA, 188 nt, unidentified
  source 1..188: mol_type = other RNA; note = Related to FOZH01000006.1; note = Enterocloster citroniae
gcagtggatcatagtgtttccggtaccacagcgggaccggccgggcagcgagtcgctgtcatggacatgtcatagcagggccgcaagaccgcaatctgctccgaggtacaaccgcacatttcatgtgcacacgcctggggcttgtacatctgcgcatcttacggtatcctttttcgtatgatccctgc

SEQ ID NO: 15965 - RNA, 185 nt, unidentified
  source 1..185: mol_type = other RNA; note = Related to NZ_FNWC01000007.1; note = Coprococcus sp.
gcaggaacgatagcatatccaagacagatgttttggcaggggagcgagtcgctgcccggtacaggagatgaaacgatgaaacgataagctgcttcgaggtacttttgcacacttcgtgtgcatggaccttgcggtccgagtacatctacgcatcttacggaatcactttattgtattgttcctgc

SEQ ID NO: 15966 - RNA, 196 nt, unidentified
  source 1..196: mol_type = other RNA; note = Related to JAGZOR010000071.1; note = Lachnospiraceae bacterium
gcagaaacaatagcagaactgaaaggacaaaatgccgtttcagcaggggagcgagtcgctgtccggtaaagtaaatgggaacatgaaacgggaagatgctgcgaagtacaaatgcacactgccgtgtgctgcggtcgctgttgcgactatggtacatcttcgcacttccggtatcaatatattgtattgtttctgc

SEQ ID NO: 15967 - RNA, 201 nt, unidentified
  source 1..201: mol_type = other RNA; note = Related to NZ_OIWX01000001.1; note = Blautia sp.
gcgggaacaatagcatatccggtatctttacgctttgctgtactgaaccggtcggggggcgagtcgccgcctgatcataaacggggagacattagacttccgaacgctccgaggtacttctgcacactgcgtgtgctgtacggccttcggcctatgtacatctgcgcattctccagaatcaccttcttgtattgttcccgc

SEQ ID NO: 15968 - RNA, 201 nt, unidentified
  source 1..201: mol_type = other RNA; note = Related to NZ_CP035945.1; note = Blautia producta
gcgggagcaatagcatatccggtatatctgtaagctgatcactgataccggtcggacggcgagtcgccgcctgatgataaattgggagaaatcagacttccgaaggctccgaggtactactgcacactgcgtgtgctgttcggcctccggcctgtgtacatctgcgcattctccagaatcaccctcttgtattgctcccgc

SEQ ID NO: 15969 - RNA, 201 nt, unidentified
  source 1..201: mol_type = other RNA; note = Lachnospiraceae bacterium; note = Related to DNJM01000030.1
gcaggagcaatagcagatccggtatgcaaggtgttgtatccggtcggacggcgagtcgccgcctgattccagaaaaagagaacataagactttcagatgctccgaggtacgtccgcacacgatgtgtgcatatggtcccggaatccgggacctgagtacatctgcgcatcttacagaatccccttattgtattgctcctgc

SEQ ID NO: 15970 - RNA, 314 nt, unidentified
  source 1..314: mol_type = other RNA; note = Lachnospiraceae bacterium M18-1; note = Related to KE159610.1
gcaggaataatagcatatccgttttcaaccgaaaggtaagaaaaggagctgtttacagagtatttctgagcagctcccagacggcagggcggcgagtcgccgtccgagaaacgatcatcagcgctccatccggaaaagggcatgtgcagaaaatctgtccgtagcagtttttccgtgctttcgccggatggagcaccggagagataagacctccggatgctccgatgtacttccgcacacttccgtgtgcttttccggcatagccttggtacacctgcgcatcctatggaatccattttttgtattgtttctgc

SEQ ID NO: 15971 - RNA, 353 nt, unidentified
  source 1..353: mol_type = other RNA; note = Related to QXWX01000071.1; note = Lachnospiraceae bacterium
gcagaagcaatagcatatccgtttttatccgaaagaaaggatcaggtgctgttcgcagagttttttgtacggctccaaaacggcagggcggcgagtcgccgtccgggaaacaatcatcagcgctccatccggacagaccatatatggaaatgcctgcggtattttttcatacagaaccatcgtatgcagaaaatctgtctgcggcagttcctctgtctttcaccggatggagcaccggggacataagacctccggatgctccgatgtacttccgcacacttccgtgtgcttttccggcatagccttggtacacctgcgcatcctatggaatccattttttgtattgctcctgc

SEQ ID NO: 15972 - RNA, 330 nt, unidentified
  source 1..330: mol_type = other RNA; note = Related to NZ_RHJS01000002.1; note = Schaedlerella arabinosiphila
gcagggacaatagcatatccgtttttcatccgaaaggaatgatcaggaacggttcgtaaaataattctgaaccgtttcctaacggcagggcggcgagtcgccgtctggaagcaatagagaactgcagaaaataactcctgcatccatgtatgtctgagttgtttttctgcagttccgatacagcgctccatccggcagaacggatggagcatcagggacagaagaccttcggatgctccgatgtacttctgcacactaccgtgtgcgtttccggcatagccttggtacacctgcgcatcctgcggaatccattttttgtattgttcctgc

SEQ ID NO: 15973 - RNA, 199 nt, unidentified
  source 1..199: mol_type = other RNA; note = Related to CP060635.1; note = Proposed Wansuia hejianensis
gcagggacaatagtatatctgggtttgcctgataactgacagcatgtccagccggatggcgagtcgccgtctggtaaagaaaaagaagccataagactttcagatgctccgaggtacttcagcacactagcgtgtgcaggcggctgcgcctgtgtacatctgcgcatcttacagaatcaccttattgtattgtccctgt

SEQ ID NO: 15974 - RNA, 200 nt, unidentified
  source 1..200: mol_type = other RNA; note = Related to CP084061.1; note = Blautia sp.
acagggacaatagcatatctggatctgtctgaaataggacagcatatccagccggatggcgagtcgccgtccggtatagaaaaagagaccaaaagacttccagatgctccgaggtacttcagcacactgccgtgtgcaggcggcttacgcctgtgtacgtctgcgcatcttacagaatcaccttcttgtattgtccctgt

SEQ ID NO: 15975 - RNA, 200 nt, unidentified
  source 1..200: mol_type = other RNA; note = Related to NZ_LT574838.1; note = Proposed Bariatricus massiliensis
acagggacaatagcacatccgggcatgtttgtacgagtacggcatatccggcggggcggcgagtcgccgtcctgcagaacaagggaaagtatgagactttcagatgctgctaggtacttcagcacactgcgtgtgcatgtcggcctgcgcctgagtaccccttcgcatcttacagaatcaccatattgtattgtccctgt

SEQ ID NO: 15976 - RNA, 197 nt, unidentified
  source 1..197: mol_type = other RNA; note = Related to NZ_CABLBR010000003.1; note = Ruminococcus gauvreauii
gcagggacaatagcatatccggatcgatacaggaatgtagagaccggccgggcggcgagtcgccgtctggtgaggaaaatcaggccatcagacttccagatgctgcgaggtacttcagcacaccggcggtgtgcatacgggcgctgccctggtacgtcttcgcatcttacagaatcatcttattgtattgtccctgt

SEQ ID NO: 15977 - RNA, 222 nt, unidentified
  source 1..222: mol_type = other RNA; note = Related to GL945165.1; note = Lachnospiraceae bacterium 1_4_56FAA
acagggacaatagcatatccattgatttttgcggcggctctgtaaggagccgccgtaagtattttgtgggcgggcggcgaaacgccgcccggaacttctaaccgaatgcaggaaactgacgccgtttccgaggcactactgcacactgcgtgtgccggatcggcttgcgcctatggtgcatcggaaccggcttacagaatctccttattgtattgtccctgt

SEQ ID NO: 15978 - RNA, 209 nt, unidentified
  source 1..209: mol_type = other RNA; note = Related to WQPN01000006.1; note = Clostridium sp.
gcaggagcaatagtgttaccggtaaactttaaatagcttccggcccggcggcgagtcgccgccgggttcatgttattcagagcaaagtctgtatatgctgcgaagtacaaccgcacacctgcggcgcttttggcgcctctggtgtgcttacgcctgcggcttgtacatctccgcatatacagtatcttcttttttagtattgcgcctgc

SEQ ID NO: 15979 - RNA, 190 nt, unidentified
  source 1..190: mol_type = other RNA; note = Related to PKUU01000015.1; note = Clostridium sp.
gcaggagcaatagtgtaaccggtttgactgaaaggattaccggcccggcggcgagtcgccgccgggaacatgatattcggaacaaagtctgtatatgctgcgaagtacatctgcacactatggtgtgcttacgcctacggcttgtacatctccgcatatacagtatcttctttttcagtattgcgcctgc

SEQ ID NO: 15980 - RNA, 202 nt, unidentified
  source 1..202: mol_type = other RNA; note = Related to AP025571.1; note = Clostridium symbiosum
gcaggaaccatagcgcagccaaagcatccgctttgggccggcggcgagtcgccgccggcggttatcaaagtcagacgcaggcagggcctgcagacttcaatttgctgcaaggtacgccgcacactttgtgtgctttctgtggctttgccacagtccggtacatcttcgcatattgaagaatctttttaagtatggttcctgc

SEQ ID NO: 15981 - RNA, 178 nt, unidentified
  source 1..178: mol_type = other RNA; note = bacterium 1XD42-8; note = Related to RAYU01000170.1
gcaaggacaatagacgatccagaaaaaactggccagggggcgagtcgccgtctggaatagaatggataggaaaaagaccccaatagcttcaatgtacttctgcacatttcatgtgctatgtgcctgcggccagtacatttacgcatattgtgatatcggataatagtattgtccttgc

SEQ ID NO: 15982 - RNA, 201 nt, unidentified
  source 1..201: mol_type = other RNA; note = Related to JAGZJZ010000010.1; note = Clostridiales bacterium
acagaggcattagtatttccggagatattttctctggccgggcagcgagtcgctgtccggatatgtatgattgaagattggtgcaggtctgcctgcacaccgtaaactgctgcgatgtacttctgcacactgcttgtgcaccgccgccttcggctcgtacagcttcgcattttacgtatcacctttttgttttgcctctgt

SEQ ID NO: 15983 - RNA, 190 nt, unidentified
  source 1..190: mol_type = other RNA; note = Related to NZ_FMJR01000027.1; note = Robinsoniella peoriensis
gcagagacattagtatttccataaattttggccgggcagcgagtcgctgtctggaattgtattcttgcagatcggtgcaggcctgcctgcacaccgtaaactgctgcgatgtacttcagcacaatgcttgtgcggccttcggttggtacaacttcgcattttacgtatcacctttttgttttgcctttgc

SEQ ID NO: 15984 - RNA, 199 nt, unidentified
  source 1..199: mol_type = other RNA; note = Related to NZ_FQVI01000010.1; note = Lactonifactor longoviformis
acagcggctgcagccaatccaaagttatttttggccggatggcgagtcgcctccccggaatcatgcaaacagtatcaggtgcagtgccctgcaccccgaaagctgcctgcaaggtacttcggcacacttcgtgtgctttggccttcggccttgtacctttccgcagctttcggtatctccttatttgtgctgccgctgt

SEQ ID NO: 15985 - RNA, 220 nt, unidentified
  source 1..220: mol_type = other RNA; note = Related to NZ_SGXF01000003.1; note = Cuneatibacter caecimuris
cgcaagacaacagtgtttctgaatacatttcagaagggcggcgagtcgccgtccgcaaagtgattggagaaggcagctgcgaagcagcggcacagttcctgtgcctgcctgcggcttgccaggtacttccgcacacggagtgtgcacggctgggcgcagagcgcccaaacgcctgagtaccaggccgcctccggcagatcttcttttggtgttgtctggg

SEQ ID NO: 15986 - RNA, 259 nt, unidentified
  source 1..259: mol_type = other RNA; note = Candidatus Fimimorpha excrementavium; note = Related to DVJD01000043.1
acagggacaacagagaaattcagttttgacagacatggtctgggaaaaagctgaccggtcggcgagtcgccgcctggaagagatggcagcctgggctgccaaatcaggaagacagaccagaagcagctccaatgtacgtccgcacatttgcgatgggaccacatttacatgtgttcccgtctccaatgtgcatgaacgccggaggcgttcggtgtacacctgcgctgcttatggaatcacctttttgtgttgcccctgt

SEQ ID NO: 15987 - RNA, 183 nt, Escherichia coli
  source 1..183: mol_type = other RNA; note = Related to CP065613.1
gcagtggcaatagcgtttccggcctttgtgccgggagggtcggcgagtcgccgacttaacgccagtagtatgtccatatacccaaagtcgcttcattgtacttaagtacgcttcgcgtacgtcgcgctgacgcgctcagtacagttacgcgccttcgggatggtttaatggtattgccgctgt

SEQ ID NO: 15988 - RNA, 180 nt, unidentified
  source 1..180: mol_type = other RNA; note = Related to NZ_BNAA01000006.1; note = Pseudocitrobacter faecalis
gcagtggcgatagcgtttctggagttatccagaagggtcggcgagtcgccgacttcacgcccgcagttcactcatatacccaaagtcgttccattgtacctcggcacgtttcacgtgcgcgcgctgtcgcgcgaagtacatttccacgccttcgggatggttttcgagtatcgccgctgt

SEQ ID NO: 15989 - RNA, 187 nt, unidentified
  source 1..187: mol_type = other RNA; note = Related to NZ_LS483470.1; note = Leminorella richardii
gcggagacaatagcgttttcaggcgcattgtcctgaacggatcggcgagtcgccgatctggcacgagcagtttggccacaaggccctaagtcattccaaagtacctcagcacgctctgcgtgcgacgcgctaacgcgctgagtacgttttcacgccttagggatcggctttatcgtattgtcgccgc

SEQ ID NO: 15990 - RNA, 185 nt, unidentified
  source 1..185: mol_type = other RNA; note = Related to NZ_JMPN01000024.1; note = Leminorella grimontii
gcggtagcaatagcgttttcagacgttctcgtttgaacgggtcggcgaatcgccgactttacgcaagcagcttggcccatataccctaagccgcgtcaaagtacatcagcacgctttgcgtgcgacgcgcttacgcgctaggtacgtttccacgccttagggatcgcttatcgtattgccgccgc

SEQ ID NO: 15991 - RNA, 175 nt, unidentified
  source 1..175: mol_type = other RNA; note = Related to NZ_RBIZ01000005.1; note = Yokenella regensburgei
agcagcagacgcagctttcccagtgaaatcactggcggagcggcgagtcgccgttctgtatttatttctgcgacattgaccctaaggtgttccggagtacgacagcacactacgtgtgcgcgcttcgcgaaggtacaccttcacaccttacggaatcattttgtggtgcgctgct

SEQ ID NO: 15992 - RNA, 174 nt, Enterobacter sp.
  source 1..174: mol_type = other RNA; note = Related to OBEF01000007.1
agcagaagcagctttcccggttgaaacaactggcggagcggcgagtcgccgttctgtactgactacctgcaacgctgaccctaaggtgctccggagtacggctgtacacgttgtgtacccgcttcgcgaatgtacaccttcgcaccttaaggaatcattttgtggtgctctgct

SEQ ID NO: 15993 - RNA, 180 nt, unidentified
  source 1..180: mol_type = other RNA; note = Related to NGMM01000007.1; note = Enterococcus sp.
acagagatgatagcgcatgcgatcgtccagatcgatctgatggtgagtcaccatcggagaggaataagggattatattcactgtaagctgatcaatgtacgcccgcacatttcatgtgcttccgccttcggctttgtacatctcacaacttacagtatcgaatttttgtgtcgtctctgt

SEQ ID NO: 15994 - RNA, 180 nt, unidentified
  source 1..180: mol_type = other RNA; note = Related to WLYM01000046.1; note = Erwinia sp.
aaagagagaatagcataactgaaacttgctttcagcctgatggtgagtcacctttgggaaaaaataatcgtgaatagtttcctgtccctcgttcaaggtacgaccgcacactacatgtgccgcgcctttggctaggtacctcttacaaggaacaggatcgttttttagtattctctctcc

SEQ ID NO: 15995 - RNA, 179 nt, unidentified
  source 1..179: mol_type = other RNA; note = Related to NZ_NGKC01000006.1; note = Vagococcus acidifermentans
aatgaggagatagccaatttgattgaaatcaattcaagagcgagtcgctcttgaaaaatagcacgggagcgattgttactgtaattcgttcaatgtgcttcagcacatgatatgtgctacagtctgcgacgacgcacatctcgctcattacagcatcatttttaagtatctttctcatt

SEQ ID NO: 15996 - RNA, 180 nt, unidentified
  source 1..180: mol_type = other RNA; note = Related to NZ_FYBT01000001.1; note = Listeria goaensis
gaagaggcaatagtttgtctaatcacatagttagacaaggatggcgagtcgtcatctgaacacaagaattcgagcattagccataaaatgctacaatgtacaactgcacattaaaatgtgctggcctgtcggcaagtacatctccgcattttacggatcgatttttagtattgcctcttt

SEQ ID NO: 15997 - RNA, 179 nt, unidentified
  source 1..179: mol_type = other RNA; note = Related to KQ130610.1; note = Listeria fleischmannii
tgagaggcaaaaggatgtctattaaccgaataggcgaggatggcgagtcgtcatctggatttagaaatgtatagattagccaccaaatgcgaaggtgtactacagcacatttcatgtgcctcgccaagtggcaagtacacctctgcatttgatggatcggtttttcgttttgcctcttt

SEQ ID NO: 15998 - RNA, 185 nt, unidentified
  source 1..185: mol_type = other RNA; note = Related to NZ_FXUT01000001.1; note = Listeria costaricensis
gaagagatcctagcaaaaaccggaattcattctggatctgttggcgagtcgccaccggataagtttctttatcggttagccgcgatctgctttaaagtactaccgcacactgcatgtgcgttcgccgacaagcggctagagtactttgacgcgactcacggttcgctttttagtaggatctcttc

SEQ ID NO: 15999 - RNA, 184 nt, unidentified
  source 1..184: mol_type = other RNA; note = Related to JAJFDR010000002.1; note = Anaerovorax odorimutans
acagagacaatagcgaagccggactttgtttcgggcgggcggcgagtcgctgtctgtatggtgagtatgagcagatcagaccgaatccggctgagatgtacttctgcacatttcatgtgcagaccttgcggtcttaggtgtacatcggcgcagattcggaattttcattttgtattgtctctgt

SEQ ID NO: 16000 - RNA, 229 nt, unidentified
  source 1..229: mol_type = other RNA; note = Candidatus Ventrisoma faecale; note = Related to DVGX01000291.1
acagaggcaatagctcagtcagacattcaatgcggcatgcagggataatctggcccgtcggcgagtcgccgccgggaggaaacacacaaggacgcgcaggcccgcagggccagcgaccataatctactgcgaagtacgccggcacacggatgtgtgcacggaccgcatgtcccatgcggtatggtacgtctgcgtatcttatggaatccttttctagtattgcctctga

SEQ ID NO: 16001 - RNA, 199 nt, unidentified
  source 1..199: mol_type = other RNA; note = Related to LR134531.1; note = Pragia fontium
atagaggcaatagcttattcagatagaattatctggatccgttggcgagtcgtcaccggataatcgatatagctaagttatgccagaccataagctgctgcaaagtacctcagcacactttgtgtgcgacgccttcggttgacctccggctgagtacgtctccgcagcttacggtatcgttttatagtattgtctctat

SEQ ID NO: 16002 - RNA, 183 nt, unidentified
  source 1..183: mol_type = other RNA; note = Related to PDDX01000001.1; note = Budvicia aquatica
atagaggcaatagcttatccggggaatcttatccggatccgctggcgagtcgtcaccggataatcgatatctgagctatagaccctaagttgctccgaagtacctcagcacacttcgtgtgcgacgcctttggctgagtacgtctgcgcaccttagggtatcgttttatagtattgcctctat

SEQ ID NO: 16003 - RNA, 194 nt, unidentified
  source 1..194: mol_type = other RNA; note = Related to NZ_PQSP01000009.1; note = Saezia sanguinis
gcagaggcaatagcttatccggatgagtcaacctcatctgggccggcagcgagtcgttgccggtaaatggttacctggaaaactcagaccatcatatgctccaatgtaccgctgcacattgcatgtgcgcatagccttcggcttttcggtacacctccacatatgatggaatcactttagcgtattgcctctgc

SEQ ID NO: 16004 - RNA, 182 nt, unidentified
  source 1..182: mol_type = other RNA; note = Peptococcaceae bacterium; note = Related to JAFYPD010000088.1
gcaggaacaatagcctatctgaatggatgcattcagcctgacggcgagtcgccgccgggaattcgcaagctgccagatgcagaccatctttgctccaaggcacatccgcacacttcgtgtgcaattgcatttcatgtgcccctccgcatgcgatggaatctctctttttgtattgttcctgc

SEQ ID NO: 16005 - RNA, 136 nt, unidentified
  source 1..136: mol_type = other RNA; note = Related to JAFRDE010000015.1; note = Ruminococcus sp.
tcttttgcggcagagtacatctttgatttttcaaaggacggacagcgagtcgctgcccgggttttacgaaaagcctcgcattccgcctgcggcgtaatgcgtacaccgcttatgcggatagttagtgccgcaaaga

SEQ ID NO: 16006 - RNA, 137 nt, unidentified
  source 1..137: mol_type = other RNA; note = Related to JAFRBD010000130.1; note = Ruminococcus sp.
tcttttgcggcagagtacatctttgatgtttcaaaggacggacagcgagtcgctgcccggggtttatgtgaagcctcgcattccgcctgcggcgtaatgcgtattccgcgtacgcggatagttagtgccgcaaaagc

SEQ ID NO: 16007 - RNA, 140 nt, unidentified
  source 1..140: mol_type = other RNA; note = Related to JAFRBX010000029.1; note = Ruminococcus sp.
ctttttgcggcagagtacatctttgatttgtttcagaggacgggcggcgagtcgctgtccgggcatcacgagaaaccgcgcattccgcttgacgcgtaatgcgacaaccgcctgaggcggatagttagtgccgcaaaagc

SEQ ID NO: 16008 - RNA, 189 nt, unidentified
  source 1..189: mol_type = other RNA; note = Related to JAFORM010000263.1; note = Ruminococcus sp.
gttttcgcggcagcgaacatctttgtttttcaaaggacgggcagcgagtcgctgtccggttttattactgcggcgttccttttccgtgaaaaggaacgttccgcaaatcttctccgctgagagtggaaaatcacttcatgatttatttctcagctccgcagctttgcggtcattgagtgccgcgaaaac

SEQ ID NO: 16009 - RNA, 177 nt, unidentified
  source 1..177: mol_type = other RNA; note = Related to JAFOUX010000084.1; note = Ruminococcus sp.
tgagaacagcaaaacggttttatgaggacggtcagcgagtcgctgtccggatagagagtaagatcagtattcgcgcggcgaatacgaagccgcaaatccgctccgccgaattaaagttcgctgcacgaactaaagattcgtctgcacggctttacggacatttagtatcagctcacg

SEQ ID NO: 16010 - RNA, 189 nt, unidentified
  source 1..189: mol_type = other RNA; note = Related to JAFUNJ010000009.1; note = Clostridia bacterium
tctttcgcagcagcgtacacaccgtttttgcggaaagggcagcgagtcgctgctttgttggtttgcccgggagcatcgcgtttgttttgaaaaacaaacgctgcctgaaaatgcctcaacgagcaaaaaaatcattccatgattgtctgctcgcctcgccatattcaggacttttcgtgctgcgaaaga

SEQ ID NO: 16011 - RNA, 188 nt, unidentified
  source 1..188: mol_type = other RNA; note = Clostridia bacterium; note = Related to JAFSIW010000012.1
ctttttttggtagtgaaccatcttgttttggcaagagcggtcagcgagtcgctgtaccgaggctttgaagtccctccgccatcctgcggatggcacatgcccgtaaaaatgctctcggtgaatgaaaaatcactgcgtgattagcaattcaccttcgcatattcacggaatttttgtaccaaaaaaag

SEQ ID NO: 16012 - RNA, 183 nt, unidentified
  source 1..183: mol_type = other RNA; note = Related to JAFNUN010000059.1; note = Clostridia bacterium
tcagccacaatagtgtagaacttgcttttttgcgagtgtaggcggcgagtcgccgttttgctttatttatttagaacgtaaatcttagaatttacccaaagaatacgctacaatgaaccaagaatcactgcgtgatttaaagttcatcttcgctttattcttaacattatgtgttgtggctga

SEQ ID NO: 16013 - RNA, 189 nt, unidentified
  source 1..189: mol_type = other RNA; note = Related to JAFSEL010000040.1; note = Ruminococcus sp.
tctttcacaatagcgcacatcttaaaaaagttttaagaggggacagcgagtcgctgttctgttaattttaaattgagatagaacattccttagaatgttcgtaccaaacaacgctcctatgactaagaaatcattttatgattcagaagtcacatccgcttgtgtttggacattttgtattgtgaaaga

SEQ ID NO: 16014 - RNA, 193 nt, unidentified
  source 1..193: mol_type = other RNA; note = Oscillospiraceae bacterium; note = Related to SVPW01000009.1
cttttcacggtagtgtacatcttgtttacaagagggaacggcgagtcgccgtttcgttagttttcttgggatagccattttgtttaaaaaacaaaatggcattctccgcacatcgcttcatcgacattcaaatcacttcgtgattatctactgtcgactttagctatgttcggggattttgtaccgtgaaaag

SEQ ID NO: 16015 - RNA, 200 nt, unidentified
  source 1..200: mol_type = other RNA; note = Related to JAFUKO010000119.1; note = Ruminococcus sp.
tcgcttgcagtagtgtaaatctctttgatttttttcaagggagggacagcgagtcgctgtttcggttttttaaaaaatgcgggctacggcttttgctcacaaaagccggctccaaattgctcttcgatgacatacaaatcactacgtgattagaaaaatgtcatctgcgtttaaatttggtcattttgtactgcgagcgg

SEQ ID NO: 16016 - RNA, 193 nt, unidentified
  source 1..193: mol_type = other RNA; note = Related to JAFOED010000001.1; note = Ruminococcus sp.
ctgtctgcagtagcttacagcttaatgaattttaagcaggggtcagcgagtcgttgtcctgtgtgttaaaaaaatcgggtatagcttttgctatgcaaaagcgcagccaaaagtcgcttcggtgacataaaaatcactttgtgattaaaaatgtcactttcgctttattttggtcattttgtgctgtggacgg

SEQ ID NO: 16017 - RNA, 193 nt, unidentified
  source 1..193: mol_type = other RNA; note = Clostridia bacterium; note = Related to JAGBTD010000211.1
tcctcgacagtagttaacaacttttatctttatgatttaagtgaggtcagcgagtcgctgtcctgtgtttttaaccttcttccgcattgctgaacgcaatgcgcacatccgattaatgctccgtcgaacaaccaatcatttcatgatttcaggttcgcctccgcatcaaccgggcagaaagtactgtcgaggg

SEQ ID NO: 16018 - RNA, 190 nt, unidentified
  source 1..190: mol_type = other RNA; note = Oscillospiraceae bacterium; note = Related to SVPP01000010.1
accccgacaacagcgaacaatcccgccaaaagcaggaaggggcagcgagtcgctgtcttgtatattttttctcgggactgcgttttacaagtaaaacgcttgccgataatttcactacgccgaatcagaaatcacttcgtgattagaaattcgtcttcgttcattaccggacattttgtgttgtcggggt

SEQ ID NO: 16019 - RNA, 185 nt, unidentified
  source 1..185: mol_type = other RNA; note = Oscillospiraceae bacterium; note = Related to SVJN01000007.1
tattttacaacagtgtacaacctgatttattcaggagggggcagcgaggtcgctgtctcggatttacgcaaggttcgcatggcactctgcgagtgcgcctgaaagaaactccatcgaataaaggaatcaccttgtgatttaatattcgcctccgtttctttcagagaaaagtgtgttgtaaaagc

SEQ ID NO: 16020 - RNA, 186 nt, unidentified
  source 1..186: mol_type = other RNA; note = Related to QUJR01000007.1; note = Butyricicoccus sp.
ccctttgcagtagcgtacaacctaaagccaatttctttaggagggacagcgagtcgctgttctggatttcaaggttatccgcatcgcatagcgatgcccaaatctgatacgctccggcgaatagccaatcacttcatgattctcgattcgcctccgcttaatcagaccattttgtactgcaaaggg

SEQ ID NO: 16021 - RNA, 201 nt, unidentified
  source 1..201: mol_type = other RNA; note = Related to DMLP01000060.1; note = Oscillospiraceae bacterium
ctccttgcagtagcgtacatcttaaagcgtaactttgagagggacggcgagtcgctgccctgattttctaaaggatttatgccttgccgcagatatatccgcggcaaggcgccgcccgataacactccgacgaacaaaagaataactccgttattttcagttcgcctgcgcttttatcgggtcattttgtactgcaagggg

SEQ ID NO: 16022 - RNA, 193 nt, unidentified
  source 1..193: mol_type = other RNA; note = Related to JACJKY010000027.1; note = Proposed Phocea massiliensis
ttctttgcagtagtgtacatcttaaagcattctttaagaaagggcagcgagtcgctgctttggtgatgaaactgagtgacgccttttcgctgacgaaaagcgcctacctgataacgcttcaacgaataccgattaactgcgttaataaaagattcgttttcgcttatatcaggatattttgtactgcaaagaa

SEQ ID NO: 16023 - RNA, 189 nt, unidentified
  source 1..189: mol_type = other RNA; note = Related to NZ_AP023418.1; note = Vescimonas coprocola
ccccgcgcagtagtgtacagcttaaagtttcgtactttgaggagggtggcgagtcgccgctctgtttaccaagaggacgcacgcttcgcaagcgaagcgaccgcctgataccgctccatcgaatcgcgaatcacgccgtgattagaaattcgactccgcttatatcaggtcactttttactgcacgggg

SEQ ID NO: 16024 - RNA, 191 nt, unidentified
  source 1..191: mol_type = other RNA; note = Related to DVGI01000013.1; note = Candidatus Fimenecus excrementavium
ccttttgcagtagtgtacatcttaaagctttctttaagaggggcagcgagtcgctgtcttgttctcaaaaaaacggggtctcattttgcacgcaaaatgcacgcctgacgtcgcttcggcgaattcaataatcacttcgtgatttaccattcgcctgcgcttcttgtcaggacacgtagtactgcaaaagg

SEQ ID NO: 16025 - RNA, 194 nt, unidentified
  source 1..194: mol_type = other RNA; note = Related to SVPJ01000007.1; note = Oscillospiraceae bacterium
ttcttttccgcagcgtacatcttaaagtgttctttaagagggggcagcgaagtcgctgtttcgttttcaaacctgcattgcgctttcggtcaaaaccgaaagcgccgccctgatgtcgcgccgtcgagtaaccaatcacttcgtgatttcaaactcgcctttgctcgtatcaggacattttgtgcggaaaagag

SEQ ID NO: 16026 - RNA, 191 nt, unidentified
  source 1..191: mol_type = other RNA; note = Oscillospiraceae bacterium; note = Related to SVPN01000018.1
acggtcgctgtagtgtacagtctttgtattttcagagaggggacggcgagtcgccgtcttgttaacggaaaagaggtccggcactcgcgtgacgagtgctgactccgaataccgctccgacgaacaacaaatcactgcatgattttaaggttcgcctccgcttgtattcgggcaatttgtacagcgaccgt

SEQ ID NO: 16027 - RNA, 139 nt, unidentified
  source 1..139: mol_type = other RNA; note = Related to NFIH01000004.1; note = Pseudoflavonifractor sp.
tgctttgcggtagagtacagggaacgaaaggttcaaggggcggcgagtcgccgtctggggtttcgatgcagtgttcgactttgactgggcaaagtcggtggcttgaatggatattcaagtattttggtaccgcaaggaa

SEQ ID NO: 16028 - RNA, 203 nt, unidentified
  source 1..203: mol_type = other RNA; note = Related to JAFQCR010000001.1; note = Clostridia bacterium
ttccctgcggcagcgtacatcttgaagtttctttaagaggggcggcgagtcgccgtcttgtgtttttacccgagcttctgcaaacgttattgcttcgcaatcacgtttgcagcccgcctgataacgttacatcgaactgatggtcacttcgtgaccaaaaggttcgccttctcttttatcaggtcattttgtgccgcagggta

SEQ ID NO: 16029 - RNA, 200 nt, unidentified
  source 1..200: mol_type = other RNA; note = Clostridia bacterium; note = Related to JAGAOS010000040.1
cttcttgcagtagcgtacatcttattttaagaatgggcggcgagtcgccgttcctgtgttttaaagggaattaccaatacggtctgcgtgttacgccacccgtattggcttttcataagaccgcttatagcgaataaatggtcacttcatgacctataaattcgctaacgctttcttatgtgattttgtactgcaggaag

SEQ ID NO: 16030 - RNA, 190 nt, unidentified
  source 1..190: mol_type = other RNA; note = Related to JAFVIF010000076.1; note = Clostridia bacterium
cctcttgcggtagcgtacgtctaaagcttgctttagggaggtcggcgagtcgccgtcctgttattctaaccctcaccgcttcgctaaaaagcgaagcgcatttccggataacgctgcggcgaataacccaatcatttcatgatttcaaattcgcctacgcttttatcaggacattttgtaccgcaagggg

SEQ ID NO: 16031 - RNA, 218 nt, unidentified
  source 1..218: mol_type = other RNA; note = Oscillospiraceae bacterium; note = Related to SVOI01000004.1
cactctacagtagtgtaaaatacttaaagttatctttaagtaaggtttaaaagaatagtcttggtgcctacagtgagcgaagtcgctctctgatgaactaaaaacttggaaatttcggcctccgccggttctcctgataacgctccaacgaataaaatgtcacttcgtgacacgcaattcgcctccgcttttatcaggtgagattgtactgtagagtg

SEQ ID NO: 16032 - RNA, 193 nt, unidentified
  source 1..193: mol_type = other RNA; note = Oscillospiraceae bacterium; note = Related to SVOH01000020.1
ccccttgcagtagcgtacatcttaaatgcaaatttaagcggggcggcgagtcgccgtctggattttttaaaaagggataactgcaagactacgtcttgcagccacctgataaacgctttgtcgaatttaatgtcactgcgtgacaaaaccattcgccgccgcttacttatcaggaattttgtactgcaagggg

SEQ ID NO: 16033 - RNA, 172 nt, unidentified
  source 1..172: mol_type = other RNA; note = Clostridia bacterium; note = Related to JAFOYN010000067.1
cccttttcagtagcgtacagcttgaagcaattcaagacgggcagcgagtcgctgtctgaggtttttgatggcccgtatccgcacgataaatccttcaatgggctcaatttttacttgcgtaaaaacaaaggcccaccttcgtatttatcatgtcattttgtactgaaaaggg

SEQ ID NO: 16034 - RNA, 187 nt, unidentified
  source 1..187: mol_type = other RNA; note = Clostridia bacterium; note = Related to JAFOFE010000078.1
ccctttgcagtagtgtacaacttgaagtatttcaagacgggcagcgagtcgctgttcggggtttttaaacctagcagtatttcttacgaaataccacctcctgataaatacttcaatgggcagcccgttatttcataacgtcagggcccaccttcgtatttatcatgtcattttgtactgcaaaggg

SEQ ID NO: 16035 - RNA, 172 nt, unidentified
  source 1..172: mol_type = other RNA; note = Clostridia bacterium; note = Related to JAFXAP010000013.1
ccccctacagtagcgtacagcttgaagcgattcaaggcgggcagcgagtcgctgtctgaggcacatttccgagccgagtttctcacctgataaatccttcaatgggtcatccgttattccataacgccacacccatcttcgtatttatcatgtcatttagtactgtaggggg

SEQ ID NO: 16036 - RNA, 187 nt, unidentified
  source 1..187: mol_type = other RNA; note = Related to JAFTLW010000024.1; note = Clostridia bacterium
ccccttacagtagtgtactacttgaagaaattcagggcggacagcgagtcgctgtctgtggcatattccgggtccgcgtttctaagcgaaacgcgccgcctgacaaacactgcaatgggctaaattttactacgtaaaaaagaccgcccacctccgtatttatcaggacattttgtactgtaagggg

SEQ ID NO: 16037 - RNA, 184 nt, unidentified
  source 1..184: mol_type = other RNA; note = Related to SVRX01000013.1; note = Oscillospiraceae bacterium
ccctttgcagtagagtacatcttgattaaagtttcaagacggtcagcgagtcgttgatcggtgtttattccctcgtgtgcggcatagccgcgtgcttgaaaaaaatctccatcgagccgctgagttacctccggtaactcagactctcgtcgatttttcccaagtcattttgtactgcaaaggg

SEQ ID NO: 16038 - RNA, 182 nt, unidentified
  source 1..182: mol_type = other RNA; note = Clostridia bacterium; note = Related to JAFVQI010000036.1
ccccccacagtagcgtacagcttgaaaaccgattttcaaggcgggcagcgagtcgctgtctgaggtccctgagggatccggccgttccggccatccacgataaatcctcgatgggttcccattttcttccgaaaataaccacccaccttcgtctttatcgtgtccttttgtactgtgggggg

SEQ ID NO: 16039 - RNA, 189 nt, unidentified
  source 1..189: mol_type = other RNA; note = Clostridia bacterium; note = Related to JAGBGQ010000166.1
atccttacagtagcgtacaacttgatttttcaagacggacagcgagtcgctgttcgaggtttttaaggtgatacgatattgaattacattcaatatcgccccatgacacttccttgatgagcagccaatcacgtatgtgatttttcggctcatctgcgtcggtatcatgacattttgtactgtaaggac

SEQ ID NO: 16040 - RNA, 201 nt, unidentified
  source 1..201: mol_type = other RNA; note = Oscillospiraceae bacterium; note = Related to SVPL01000026.1
ctctttgcaatagtgattgacttgattttatcaaggcgggggtggcgagtcgccacttaaggattttaaagtggattacgcttttcagtttttataaaaacctgaaaagcgccgctgtaaaccgcttctttgaacacagtaatcactgcgtgattttaagttcaactacgcttgtttacagtgcttttgtattgcaaagag

SEQ ID NO: 16041 - RNA, 167 nt, unidentified
  source 1..167: mol_type = other RNA; note = Related to RKDE01000011.1; note = Clostridiales bacterium
gcagctatgatagcgattaccttaagcagtgtaaggttggacagcgagtcgttgcccataataaacaattaagcacaacaaataaacaaagtttcgctgaattaaaaattgctaccacaattcagaattcacctcaacttatgttttatcgaaagtatcatagctgc

SEQ ID NO: 16042 - RNA, 173 nt, unidentified
  source 1..173: mol_type = other RNA; note = Related to JAFUWO010000134.1; note = Eubacterium sp.
acagctatggtagcgattaccttgattgatattaaggttgagtggcgagtcgccattcataatgatatatttgaaagatactgacgaacacagcctcaacgaattccaaatagcgctgaagcactattcaaaattcgcctcggctatgtccgtatctaaagtaccatagctgt

SEQ ID NO: 16043 - RNA, 156 nt, unidentified
  source 1..156: mol_type = other RNA; note = Related to NZ_HG005285.1; note = Candidatus Stoquefichus massiliensis AP9
ttatgaacaatagtgatatacgaaactttagcgagtcgctaaagaatgagaaaaataaagacatggaaattgtcatattccaaggggcttaactacacgagacatgtagagtcaccgcccatttccatatgacaatatcatttgtattgttcagca

SEQ ID NO: 16044 - RNA, 166 nt, unidentified
  source 1..166: mol_type = other RNA; note = Related to NZ_LN852692.1; note = Candidatus Stoquefichus sp. SB1
ataagaacaatagtgaaaggaatatacctcctttagcgagtcgttaaaggtcaagaagaattatgatatggaattgttatatttcaatggacttaactacactaacatgtagacgctaacgcttcggcccatttccatataacaatatcgtaagtattgttcttat

SEQ ID NO: 16045 - RNA, 180 nt, unidentified
  source 1..180: mol_type = other RNA; note = Candidatus Coprovivens excrementavium; note = Related to DVII01000099.1
acaagagcagtagtgattggaattttataaaaaaaaattccccctttaatgagtcattaaagatcaaagtaacatttaagattgaattgtaatattccataagacttctctacactgcgtgtagaaacgctgacgcttacgtcgaattccatattacaatatctgaagtattgctcttgt

SEQ ID NO: 16046 - RNA, 168 nt, unidentified
  source 1..168: mol_type = other RNA; note = Candidatus Fimihabitans intestinipullorum; note = Related to DVML01000007.1
gattttgcagtagtgattggaattatttcctactttaacgagtcgttaagggactagattgatgataacgataaaattgtaatattccaaaggactaacctacacggtgtgtaggcgcttcgctttaagtccatttccatattacaatatcgctagtactgcacacag

SEQ ID NO: 16047 - RNA, 177 nt, unidentified
  source 1..177: mol_type = other RNA; note = Bacilli bacterium; note = Related to JAFRQS010000031.1
acctgtgcagtggcgattggatttatttctactttaacgagtcgttaagggacaatattaattaagatgattaaattataattctccaaaggactaaactacatttcatgtagacgcttcgttgcactacgctttaagtccatttccaaattataatatcattagcactgcataaaa

SEQ ID NO: 16048 - RNA, 179 nt, unidentified
  source 1..179: mol_type = other RNA; note = Related to FR887372.1; note = Clostridium sp.
attctcggcagtggtgattggaattatttcctactttaacgagtcgttaagggactaatttatttaagatgatttaatagtaatacttcaatgaacttacctacatttcatgtagtcgcttcgctatgctacgctttgagttcatctccatattacaatatcatgagcactgcaatagt

SEQ ID NO: 16049 - RNA, 180 nt, unidentified
  source 1..180: mol_type = other RNA; note = Firmicutes bacterium; note = Related to DLWG01000243.1
ttttatgcagtagtgattggaattttttttcctactttaacgagtcgttaagggacgatatttatttaagagattgaatagtaatattccaagggacttatctacaccttgtgtaggcgctacgcgatgcttcgctttaagtccatctccatattactatatcattagtactgcatatat

SEQ ID NO: 16050 - RNA, 164 nt, unidentified
  source 1..164: mol_type = other RNA; note = Related to JAFRAB010000047.1; note = Erysipelotrichaceae bacterium
acagttgcagtagtgattggagcaattcctgccttagcgagtcgttaagggacagttttattaccgggatcaattgcaatatttcagtgggcgacactacatttcatgtaggaggcttcgcttcgcccacttccatatttcaatatctttagtactgcagaagg

SEQ ID NO: 16051 - RNA, 164 nt, unidentified
  source 1..164: mol_type = other RNA; note = Related to JAFWHJ010000089.1; note = Erysipelotrichaceae bacterium
acaattgcagtagtgattggagcaattcctgccttagcgagtcgttaagggacagttttattaccgggatcaattgcaatattacagtgggcgatactacatttcatgtaggaggcttcgctccgcccacttccatatttcaatatctttagtactgcagaagg

SEQ ID NO: 16052 - RNA, 166 nt, unidentified
  source 1..166: mol_type = other RNA; note = Related to JAFTRC010000024.1; note = Bacilli bacterium
ttttgagcaatagtgtatggatttattccaactttaacgagtcgttaaagtacgattttaactataatatataattgtaatattccaaaggaccaacctacaccctgtgtagtcgcttcgcttttagtccatttccatattacaatatcttaagtattgctctaaa

SEQ ID NO: 16053 - RNA, 166 nt, unidentified
  source 1..166: mol_type = other RNA; note = Related to JAFQQQ010000003.1; note = Bacilli bacterium
tttcgagcaatagtgtatggatttattccagctttagcgagtcgttaaagtacgtttttaactataatataaaattgtaatattccaaaggaccaacctacacgctgtgtagtcgctacgcttttagtccatttccatattacaatattttaagtattgctcttaa

SEQ ID NO: 16054 - RNA, 173 nt, unidentified
  source 1..173: mol_type = other RNA; note = Bacilli bacterium; note = Related to JAFQTN010000005.1
tcagtatcaatagcgtttggattttctaatccactttagcgagtcgttaaagcataaaatttattaatatgatgaattgtaatactccaatggacctaactacactacgtgtagcgcggcttcgccttatagtccaattccatattacaatatcactaatgtattgatactac

SEQ ID NO: 16055 - RNA, 171 nt, unidentified
  source 1..171: mol_type = other RNA; note = Related to HF998250.1; note = Coprobacillus sp.
tattaagcaacagcgaataggaattaattattcccactttagcgagtcgttaaagttctaaaataatatagataatgattgaactattccagtggagtatactacatttcatgtagccgctaacgcttctctccaccttcatatttcaatatcactaagtgttgctaaaag

SEQ ID NO: 16056 - RNA, 158 nt, unidentified
  source 1..158: mol_type = other RNA; note = Related to HF993109.1; note = Mycoplasma sp.
aatcaagcaatagcaattggttttaaaccactttgatgagtcatcaaggatatttaattaaagaattatgtgattatattactccaagtgattactctaaacgttatttagttaaatcactctccataatataatatcacatcaagtattgcttattt

SEQ ID NO: 16057 - RNA, 173 nt, unidentified
  source 1..173: mol_type = other RNA; note = Related to DVMT01000048.1; note = Candidatus Aphodocola excrementigallinarum
tgtaagcaagtagcgttttgattttttttaaaaatctttttagcgagtcgctaaagtaagaaacactaaataaatacattatattgataacgctcaatgtatcatattacgcttaaaagcgtaaatgaaacatacatttcgctagttacaatatattatagtacttgctttat

SEQ ID NO: 16058 - RNA, 195 nt, unidentified
  source 1..195: mol_type = other RNA; note = Firmicutes bacterium CAG:822; note = Related to HF990861.1
gtaagagcaatagtggtttgaaaattatttcatactttagcgagtcgctaagggactagattaagtgttacaataatgattatagaatttaaatcattatgattgtaatattccaccgtgcttaactacactacgtgtagtcgcttacgctttatgcacgttttcatattacaatatcttgggtattgctctttt

SEQ ID NO: 16059 - RNA, 181 nt, unidentified
  source 1..181: mol_type = other RNA; note = Firmicutes bacterium; note = Related to SVAM01000009.1
aggaaagcagtagatttatctaatttatttagatagaaagacgagtcgtctgttcgaaaagaatttattatacatatttgcttatattgtacgaagtagagcgcctaaaggctatagtatatttccaatatacttatctacatcttaacaatacaagataattttaaagtactgctttttt

SEQ ID NO: 16060 - RNA, 159 nt, unidentified
  source 1..159: mol_type = other RNA; note = Related to JAFWVI010000074.1; note = Ruminococcus sp.
cagccgtcggcagtgaatttgcacaagcaaagctgcggcgagtcgccgcggatgattttaggaataagaccgatataaaaagttcttcaccgaatccaaattaactgcgttaataaaaattcggctccgaacattttaatgcttttgtgccggcggctg

SEQ ID NO: 16061 - RNA, 160 nt, unidentified
  source 1..160: mol_type = other RNA; note = Related to FPJT01000001.1; note = Ruminococcus flavefaciens
cagccgtcggcagcgaatttgcacaagcaaagctgcggcgagtcgccgcggatgatttcaggaatattaccgatataaaaagttctccaccgaatcatgaattaacttcgttaatagaaattcggctccgaacattttaatgcttttgtgccgtcggctg

SEQ ID NO: 16062 - RNA, 159 nt, unidentified
  source 1..159: mol_type = other RNA; note = Related to JAFTYF010000065.1; note = Ruminococcus sp.
cagccgttggcagcgaatttgcacaagcaaaactgcggcgagtcgccgcgggtgattttaggactaagatcaaaataaaaagttctccaccgaatccgaattaactgcgttaataaaaattcggctccgaacgttttaatgcttttgtgccggcggctg

SEQ ID NO: 16063 - RNA, 160 nt, unidentified
  source 1..160: mol_type = other RNA; note = Related to NZ_JAEF01000007.1; note = Ruminococcus flavefaciens
cagccgttgacagtgaatttgccaagcaaaactgcggcgagtcgccgcggcattttttaggaataagaacataagcaaaagtttctccgccgaataaaatattaacggtgttaatttaaattcggctccgaaacatttgaatgctttgtgtcaacggctg

SEQ ID NO: 16064 - RNA, 159 nt, unidentified
  source 1..159: mol_type = other RNA; note = Related to JAFPPE010000436.1; note = Ruminococcus sp.
cagccgccggcagcgtatttgtaaaggcaaaactgcggcgagtcgctgcggcttttttcagaattatgtccattatcaaaagtttttcactgaataactgctaacgctgttagctataaattcagtttcaaaacatttgaatctttgtgccggcggctg

SEQ ID NO: 16065 - RNA, 172 nt, unidentified
  source 1..172: mol_type = other RNA; note = Related to JAFXEJ010000141.1; note = Ruminococcus sp.
cagctgtcggcagcgaatttgcaaatgcatctgcaatgcattactgcggcgagtcgccgtggggatttttaggaataagtccataatcaaaagtttctccaccgaatttaaattaacttcgttaatacttattcggttgcgaaacatttgaatgcttttgtgccggcagctg

SEQ ID NO: 16066 - RNA, 173 nt, unidentified
  source 1..173: mol_type = other RNA; note = Related to JAFVBU010000121.1; note = Ruminococcus sp.
cagctatcggcagtgatattgcaaatgcatttccgcaatgcacgactgcggcgagtcgccgtggagttatcaggaatgagcccattatcaaaggtttctccgctgaataataaattaactgcgttaatagaaattcagctccgaaacatttgaatgttttgtgccgatggctg

SEQ ID NO: 16067 - RNA, 173 nt, unidentified
  source 1..173: mol_type = other RNA; note = Related to JAGAMS010000071.1; note = Ruminococcus sp.
caactgtcggcagcgatattgcaatgcgtaactgcaagcgcataactgcggcgagtcgccgtgggtttttttaggaacaagtccattatcaaaggtttctccactgaatctaaattaacttcgttaattataattcagctccgaaacgtttgaatgttttgtgccaacagtat

SEQ ID NO: 16068 - RNA, 163 nt, unidentified
  source 1..163: mol_type = other RNA; note = Related to UETD01000003.1; note = Ruminococcus flavefaciens
cgggctgcggcagcgtaacgcatgatgtgcgactgcggcgagtcgccgcggaaatcatttaaaaccacggactttatcacaagtttctccgacgaattccaattaactccgttaataataagattcgtctccgaaacatatgaatgttttgtgccgcagcctg

SEQ ID NO: 16069 - RNA, 164 nt, unidentified
  source 1..164: mol_type = other RNA; note = Related to NZ_ATAX01000036.1; note = Ruminococcus flavefaciens
agggctgcggcagcggtgcacatgatgcgcgactgcggcgagtcgccgcggaagatcattctcaggtaaggactttgtcataaattcctccgacgaatttcaattaacttcgttaataaggttattcgtctccggaacatatgaatgttttgtaccgcagcctt

SEQ ID NO: 16070 - RNA, 159 nt, unidentified
  source 1..159: mol_type = other RNA; note = Related to JAGPNI010000006.1; note = Ruminococcus sp.
cagctgccggcagcgttttgcactgcatacagcggcgagtcgccgctgggctttcaggagtatccacatgagcaaatgcctgctccgctgaataattccgtcaactgtgttgactaaaattcagctccccagcatttgaatgatctgtgccggcagcct

SEQ ID NO: 16071 - RNA, 159 nt, unidentified
  source 1..159: mol_type = other RNA; note = Related to JAFUAO010000003.1; note = Ruminococcus sp.
agacgccggcagcgttttgcacttgcatactgcggcgagtcgccgcagggctttcaggaatatccacatgagcaaatgtcagctccactgaataaataagtcaacttcgttgacttcaattcagctccgccgcatttgaatgttttgtgccggcagtct

SEQ ID NO: 16072 - RNA, 171 nt, unidentified
  source 1..171: mol_type = other RNA; note = Related to JAFZOZ010000090.1; note = Clostridia bacterium
cgggcgccggcagcgatactgcagcggcaggcacactgcatgaccgcggcgagtcgccgcgggagcgttcagatcacagcccatgatcaaaagtttctccaccgaataagaattaactgcgttaatcggaattcggctccgaaacatttgaataccttgtgcccgcgtccg

SEQ ID NO: 16073 - RNA, 159 nt, unidentified
  source 1..159: mol_type = other RNA; note = Related to NZ_HF545616.1; note = Ruminococcus sp.
caagcgtcagcagcgatattgcaaaacgcataactacagcgagtcgctgtggaagtttcagggaatagtagctttgtcaaaagctttttcaccgaatcggatttaattccattaaataaaattcggctccaaagcatttgaatcttgtgctgacgcttg

SEQ ID NO: 16074 - RNA, 237 nt, unidentified
  source 1..237: mol_type = other RNA; note = Related to SVTP01000007.1; note = Oscillospiraceae bacterium
ggcagaacaacagtgtatttcgattttcgaaagggatggcgagtcgtcatcttttcacctacggttagcgtattcgctgcacaagccctgcaaaagtctttccgacacgcgagcgtctcgggacttttgacgtcggtcttgttccgctcagtcgaaatgctcgacgaagtgatacaaggcgatgccttgtagtactacgtctgcgcgtttcgccatacaaattggtgttgttctgat

SEQ ID NO: 16075 - RNA, 249 nt, unidentified
  source 1..249: mol_type = other RNA; note = Related to SVQS01000086.1; note = Oscillospiraceae bacterium
aacagaacaacagtgtatttcgatttttttcgaaagggatggcgagtcgtcatcttttcactcatggctatcgtattcgctgcacaagccctacaaaagtcttccgacacgcgagcgtttcgggacttttgccaacggtcttgttccactcagtcgaaatgctcgacgtagtctagcaaggtttcgtaaaactcaccttgctatcggtacgtctgcgcgtttcgccatacaaattggtgttgttctaat

SEQ ID NO: 16076 - RNA, 234 nt, unidentified
  source 1..234: mol_type = other RNA; note = Oscillospiraceae bacterium; note = Related to SVRN01000036.1
aacagaacaacagtgtatttcggtattcgaaagggatggcgagtcgtcatcttttcactcacgctcagctcattcgctgcacaagccctacaaaagacttccttcggaagcttttgctgaacggacttgttccactcagtcgaaatgctcatcgtagcgccgcaaggttacgtaaactacaccttgctgatctacgtctgcgcgtttcgccatgcaaattagtgttgttctatg

SEQ ID NO: 16077 - RNA, 237 nt, unidentified
  source 1..237: mol_type = other RNA; note = Oscillospiraceae bacterium; note = Related to SVST01000008.1
aacagaacaacagtgtatttcggtttctacgaaagggatgacgagtcgtcatcttttcactcatattgatcgtattcgcggcacaagtcctacaaaagcttttctcgaaagcttttgcttaacggacttgttccgttcagcctaaccgcgccactgtagtcaccgcaaggctccgcacgcttcaccttgctaaactacacctctgcgattagccatacaaattcgtgttgttctgaa

SEQ ID NO: 16078 - RNA, 253 nt, unidentified
  source 1..253: mol_type = other RNA; note = Related to JAGALS010000020.1; note = Clostridia bacterium
caaggaacaacagtgtatttcatttttgaaagggatggcgagtcgccatcttttcactcacgtttgtctcattctctgcacaagcctacaaaaaagctttcttgcgatcgcaagcgattctcagaaactttttgtgcttaacggcttgctccgctcagcctaaatgctcaccgtagccgaggcaaggttgcgcaagcttcaccttgcaaaactacgcttgcgctttagccatgctgattcgtgttgttccaaa

SEQ ID NO: 16079 - RNA, 262 nt, unidentified
  source 1..262: mol_type = other RNA; note = Clostridia bacterium; note = Related to JAFTNT010000011.1
cttagaacaacagtgtatttcgttttttacgaagggggtgacgagtcgtcaccttttcacccaagcttaacgtattcgttatacaagcctacaaaaaagctttcttccgcaaatcgcaagcgatttcttcagaaactttttatgcttaacggcttgctccactcagcctaaatgctcgatgtattcgatgcaaggcgtcgcaggctttgccttgcttaaatacgtctgcgcgtttagccatgcaaattagtgttgttctaaa

SEQ ID NO: 16080 - RNA, 250 nt, unidentified
  source 1..250: mol_type = other RNA; note = Bacilli bacterium; note = Related to JAFVUY010000073.1
tatagaacaacagtgtatttctttttatagaagaaagggatggcgagtcgtcatcttatcacttatatttaccgtattcgctgcacaagtcctacaaaagctttttcttctattcggcaggctcattcagaaaaacttttgcttaacggtcttgttccgttcagtcgaaatgctcatcgtagtcccgcaaagctatgctttgcccccctacgtctgcgcgtttcgccatacaaattggtgttgttctata

SEQ ID NO: 16081 - RNA, 261 nt, unidentified
  source 1..261: mol_type = other RNA; note = Related to SVHW01000007.1; note = Clostridiales bacterium
aatagaacaacagtgtattttgacttttgtcaaaaaggatggcgagtcgtcatcttgtcacttatatgtatcgtattcgctgcgcgcaacctacaaaagaaatattgcgtccgagacatttcattgacgtcaatattcttttgtgtaacggttgtgctccgctcaactgcaatgctcgacgtagccacgcaaggcttcgcaggctacaccttgcctaactacgcctgctgcgtttcgtgtacaaattggtgttgttctaaa

SEQ ID NO: 16082 - RNA, 243 nt, unidentified
  source 1..243: mol_type = other RNA; note = Clostridia bacterium; note = Related to JAFXAN010000018.1
tgaagaacaacagtgtatttcgattctcgaaagggatggcgagtcgtcatcttgtcacttatatttagcgtattcgctgcacaagcctacaaaagcttttcctcggtgctcggttcgcattcgaaaaagcttttgcttaacggcttgctccgctcagctgaaagcctcgacataattctgcaaggcttcgccttgctattctatgtctgcgactttcatcatacaaattagtgttgttctgaa

SEQ ID NO: 16083 - RNA, 259 nt, unidentified
  source 1..259: mol_type = other RNA; note = Related to JAFTHO010000004.1; note = Clostridia bacterium
gacagaacaacagtgcatttcggtttttatcgaaagggatgacgagtcgtcatccttgcaattatctttaacatattcgttacacacaccctacgaaaaatcgtttgtatcgaaaaatccgttgtgattttgtctcacaaacgtttttcgtggccgggcgcgttccgctcagacgaaatggtcggcgtataggatgcaaagcggtgctttgctgcaatacgcctgcacattacgccatacaaacaagtgttgttctgtc

SEQ ID NO: 16084 - RNA, 180 nt, unidentified
  source 1..180: mol_type = other RNA; note = Related to JAFVYN010000052.1; note = Clostridia bacterium
aaatgaacaatagtgtttcgactctgtcgacggggcggcgattcgccgtcctttcacgcatatccttcgtattcgctgcgctcaaagaaatcgcttggcgtaatcgcttcgctttgtgcgactgacgtcgcacggaaatacgccgcacgatatcttatgcacaatttgtattgttcaagg

SEQ ID NO: 16085 - RNA, 183 nt, unidentified
  source 1..183: mol_type = other RNA; note = Clostridia bacterium; note = Related to JAFTKF010000062.1
aaatgaacaatagtgtatttcgattctgtcgaaacgggcggcgagtcgccgtctgacacccctacccttccgtattcgcaaggctcagatgaaatgcttggcgtaaacgctggcgctttgtgcgccttcggcgcacggatatacgcccgcgcatttcctcatacaaatctgtattgttcgaag

SEQ ID NO: 16086 - RNA, 191 nt, unidentified
  source 1..191: mol_type = other RNA; note = Related to JAFTRY010000008.1; note = Clostridia bacterium
aagaaaacaatagtgttattcgatttatcaatcgaaccgtgagcgagtcgctctcggtattcaaatattttcgtattcgcaagctcaaatgaaaagcttgaagtaaaccgcgcacagagtgcgctaaatgcgactgacgacgcatttcattactcctgcgcttttcatcatacaattagtattgtttaagg

SEQ ID NO: 16087 - RNA, 189 nt, unidentified
  source 1..189: mol_type = other RNA; note = Related to SVSM01000002.1; note = Oscillospiraceae bacterium
aaaaaaacaatagtgttattcgatttattatcgaaccgtgagcgagtcgttctcggcagttaatcttttcgtattcgcaggctcaaatgaaagagcttgaagtaattcgcgcacaagtgcgctatatgcgactttcgtcgcatatccttactcctgcgcctttcattatacaatttgtattgtttgagg

SEQ ID NO: 16088 - RNA, 203 nt, unidentified
  source 1..203: mol_type = other RNA; note = Clostridia bacterium; note = Related to JAFVSI010000037.1
aaatgaacaatagcgttattcggtttttaaatcgagccgtgagcgagtcgctctcggtagcaaaatttttcacgtattcgcagggctcaaatgaaaatcttgaagtaagaccgcaatactgtgcaagcacagtttgctaatgtgcgacaagtcgcaccgagttactcctgcgtttttcattatacaaatagtattgttcaagg

SEQ ID NO: 16089 - RNA, 188 nt, unidentified
  source 1..188: mol_type = other RNA; note = Oscillospiraceae bacterium; note = Related to SVRW01000015.1
atttgaacaatagcgttataggtttttacatgccgtgagcgagtcgctctcggaagaattaaactatcctcattcgttttactcagatgaaaacgtcgggagtaagcgcgcactgtgtgcgcttaagtgcggcaagccgcaccacattacacccgcccttttcaccatacaataagtattgttcaaaa

SEQ ID NO: 16090 - RNA, 191 nt, unidentified
  source 1..191: mol_type = other RNA; note = Related to JAFTKI010000072.1; note = Clostridia bacterium
cttcgaacaatagcgttattcgattttatcgagccgtgagcgagtcgctctcggtaacccgcaattccccgtattcgctgtcgctcagcgaaaagtcttggagtaagtcgcgcaaaaatttgcgctgagtgcggcatagccgcactactttacaccttcgcctttccgtatacaatcagtattgttcaaaa

SEQ ID NO: 16091 - RNA, 208 nt, unidentified
  source 1..208: mol_type = other RNA; note = Related to JAFVTO010000133.1; note = Clostridia bacterium
gcacgaacaatagcgttgggatgatatcctctcaggagcctgactccggatgactcatcctccgtcggcgagtcgcctacggaaaaagtataatacccgtattcgctacgctcagatgaaaatctcagcgtaaacgcttcgcttagttcgtcgttgccgaactgcattacgcttgcgattttcagcatgcacatagtattgttcaaga

SEQ ID NO: 16092 - RNA, 193 nt, unidentified
  source 1..193: mol_type = other RNA; note = Related to JAFTUH010000073.1; note = Clostridia bacterium
tcccgaacaatagtgtcacttgatttttcaagccggcagcgagtcgctgtcggaggcagtaaccctgccgtattcgctgcgctcagatgaaaatgctcggagtaaaaaccattcctgcggaatggtgacgtacgccttcgacgtacctcattacacctgcgcttttcagcatacaaatttgtattgttcaggg

SEQ ID NO: 16093 - RNA, 176 nt, unidentified
  source 1..176: mol_type = other RNA; note = Clostridia bacterium; note = Related to JAGBRZ010000213.1
tgcaaggcaatagtgttgttcgttttattacgacattgatagcgagtcgctatcgataacatcaaaccttatctcattcgcgcagctcaagcaaagttgctcaatgtagtttagaggcacacttcatgtgcggcactacatttcgccccattgctatacaaatgtattgccttgca

SEQ ID NO: 16094 - RNA, 174 nt, unidentified
  source 1..174: mol_type = other RNA; note = Related to JAFTOR010000034.1; note = Clostridia bacterium
cgcaaggcaatagtgttgttcgtttgattacggcgttgatagcgagtcgctatcgataacatttagccttataccattcgcgttgctcaagcaaaatgctcaatgtagctcgcggcacatttcatgtgctaaactacatttcgccttattgctatacaaatgtattgctttgcg

SEQ ID NO: 16095 - RNA, 172 nt, unidentified
  source 1..172: mol_type = other RNA; note = Clostridia bacterium; note = Related to JAGAMD010000012.1
catagggcaatagtgtattccatttaggagtcgatagcgagtcgctattgatacaattcaattttacatatttcgcaaatgctcaagcaaaaacactccatgtagtaaatccgcccaccatatgggctgtcctacatatcgcattcttgccatacaaatgtattgtcctatg

SEQ ID NO: 16096 - RNA, 185 nt, unidentified
  source 1..185: mol_type = other RNA; note = Related to JAFQLX010000091.1; note = Clostridia bacterium
taaagggcaatagcgatttttgtttataatacaaactcggcggcgagtcgccaaccgagccgcatttaccccgtatattgagacgaaagtgagcgcagtatcatagcacattttatgtgcacgtgcgcgttttgcgcacttaatacagcgcttcatttcgccatacagcattgtattgccctttt

SEQ ID NO: 16097 - RNA, 430 nt, unidentified
  source 1..430: mol_type = other RNA; note = Clostridia bacterium; note = Related to JAGBUH010000087.1
taaagaacaatagcgtgaatttggtattcttatcaaaaacggcggcgagtcgctgtcgtatagcataaaagagtcgaacccataatggtttgaaaagctattttcgcccataatttcgcaattctcgttaggaatacgcccgtattccgtcgctcaccttgctcattctggacaaaaatttcaatttcaaacgcacctacggcgaggtagtttcgagaagaaattttgtttttgagcgcagatatactaacgtatatcaagcgaaaaaacaggcattgtgtgttcgattcttttatgctatagcacaaaaccttcgtatatcgcgcgtcgcgcacgaaaaattgctcgaagtagaactgcacacgctgtgtgcgcgctttcgcttttctacatctgcgcattttccgtatacaaaatgtattgttctggt

SEQ ID NO: 16098 - RNA, 173 nt, unidentified
  source 1..173: mol_type = other RNA; note = Clostridia bacterium; note = Related to JAFSIE010000307.1
agcagagcatcagcgtttttcagcttttgcctgaatcgtcagcgagtcgctgccgatagcgtaacctcgtatactcgcacagctcgagagaaattgctggatgtgttaaagcacatgatatgtgcaaataaacacatctgcacaatttcctatacacatagtcttgctctgct

SEQ ID NO: 16099 - RNA, 192 nt, unidentified
  source 1..192: mol_type = other RNA; note = Clostridia bacterium; note = Related to JAFTLM010000135.1
aacagaacggtagcttgtttcggatatccgaagtcggcggcgagtcgcctccgacagtaaaaaactttttcgtattcgcgttgctcagccgagcgttcttcagcgtagccggtacacagagtgtacctcgagcacacgttgtgtgctacactacgcctacgcccgtcgtcatgcaaaaaagtaccgtcagaa

SEQ ID NO: 16100 - RNA, 193 nt, unidentified
  source 1..193: mol_type = other RNA; note = Related to JAFNUZ010000041.1; note = Clostridia bacterium
aagtgaacggtagcttatttcggatatccgaagtcggcggcgagtcgccgtcgataattttcaagcttttcgtattcgctttgctcagccgagcgttcttcggcgtagccggtacacgctgtgtaccttcagcacaccttgtgtgcgttcctacgcctacgcccgtcgtcatgcaaaaaagtaccgttgaaag

SEQ ID NO: 16101 - RNA, 165 nt, unidentified
  source 1..165: mol_type = other RNA; note = Related to JAGBSO010000048.1; note = Clostridia bacterium
tcaggagcaatagattttatcttttttcaagatagcgtcagcgagtcgctgaacgtaattttcaatcgtataacgcgggcgaaatgctcgctataatccaacacactgacatgtgtcaaaagttatagcttcgcatttcggcatacggatattgtattgctctga

SEQ ID NO: 16102 - RNA, 227 nt, unidentified
  source 1..227: mol_type = other RNA; note = Related to JAFQKX010000056.1; note = Clostridia bacterium
ataggaacaatagcttttgtcaaaattatggcaccggcagcgagtcgccgtcgggtagcatgaagtattcgtattcgcttgcgctcagtcgaattgctcgcagtatttcagcacacgttgtgtgcgccaccgcgacgtgagtaaaatatgcctgcgtcatattctactcacgtccgcacccaaaatactgctgcgcacttcgccgtacatcattgtattgttccgta

SEQ ID NO: 16103 - RNA, 201 nt, unidentified
  source 1..201: mol_type = other RNA; note = Related to JAGAUY010000021.1; note = Oscillospiraceae bacterium
tcaggaacaatagcttttgtcaggccactggcaccggcagcgagtcgctaccgggtagcgcatatttcacgtattcgcttcgctcagacgaactgcttgcagtattccagcacacgttgtgtgcccaccgcggcacatttcatgtgcccgcaccccggatactgctgcgcacttcgccgtacatcattgtattgttccact

SEQ ID NO: 16104 - RNA, 202 nt, unidentified
  source 1..202: mol_type = other RNA; note = Related to JAFQIL010000045.1; note = Oscillospiraceae bacterium
ttaggaacaatagcttttgtcagaatactggcaccggcagcgagtcgcttccgggtagcatccatccaccgtattcgcttcgctcagccgaactgcttgcagtatttcagcacacgttgtgtgcgccaccgcggcacatttcatgtgcccgcaccctaaatactgcagcgcatttcgccatacatcattgtattgttccaat

SEQ ID NO: 16105 - RNA, 201 nt, unidentified
  source 1..201: mol_type = other RNA; note = Oscillospiraceae bacterium; note = Related to JAFQNL010000019.1
tgtggaacaatagcttttgtcagatcactggcaccggcagcgagtcgctgtcggatagcgcaaattcaacgtattcgcttcgctcagccgaactgcttgcagtattcctgcacacgctgtgtgcccaccgcggcacatttcatgtgcccgcaccccggatactgctgcgcacttcgccatacatcattgtattgttccaga

SEQ ID NO: 16106 - RNA, 202 nt, unidentified
  source 1..202: mol_type = other RNA; note = Related to JAFVXA010000039.1; note = Oscillospiraceae bacterium
gtgggaacaatagcttttgtcagatcattggcaccggcagcgagtcgctgtcggcaggcacatggtatcgtattcgctttgctcagtggaactgcttgcagtatttcagcacactccgtgtgcgccaccgcggcacatttcatgtgcccgcaccccaaaatactgctgcgcatttcgccatacatcattgtattgttccgat

SEQ ID NO: 16107 - RNA, 174 nt, unidentified
  source 1..174: mol_type = other RNA; note = Related to JAFTVM010000054.1; note = Oscillospiraceae bacterium
catggaacaatagcttttgtcagacctctggcaccggcagcgagtcgctgccgggaagcacctggccatcgtattcgcttgcgctcagacgaactgcttgcggtattaccgcacacgctgtgtgctggagaatacccctgcacacttcgccatacatcattgtattgttccgga

SEQ ID NO: 16108 - RNA, 175 nt, unidentified
  source 1..175: mol_type = other RNA; note = Candidatus Faecousia faecavium; note = Related to DVGO01000036.1
tcaggaacaatagcgtttgtcaacacccgttggcatcggcagcgagtcgctgccggttcgcagaaacctgcctcattcgcaatgctcagcccaagtgcttgcggtatttccgcacaccctgtgtgctttcagataccgccgcacactttggcatacatcatggtattgttcctta

SEQ ID NO: 16109 - RNA, 177 nt, unidentified
  source 1..177: mol_type = other RNA; note = Related to WNBA01000006.1; note = Pseudoflavonifractor sp.
cacggaacaaaagtgtccgtccggcagacccggcaccggcggcgagtcgccgccgggcggcagataccctatcgtattcgcttcgctcagccgaagcagcacagcggtattcctgcacactgcatgtgcatcaaaataccgctgagccgttcgccatacatcttgttttgttccgta

SEQ ID NO: 16110 - RNA, 178 nt, unidentified
  source 1..178: mol_type = other RNA; note = Related to KE159708.1; note = Oscillibacter sp.
cacggaacaaaaggaaccgtccaatttcgattggcgccggcggcgtgtcgccgtccggttttcgcacacccaccgtattcgctccgctcagccgcgccgctccgaggtagaaccgcacggctgcaccgtgctcttgctaccgctccgcggcccgacatgcagatggttttgttccgaa

SEQ ID NO: 16111 - RNA, 171 nt, unidentified
  source 1..171: mol_type = other RNA; note = Related to DXIA01000170.1; note = Candidatus Pygmaiobacter gallistercoris
acagcaggcggcagaaaaagcctttttggccccgacagcgagtcgctgtcggtttgttttatcacacacaggtttcgctgacactcagccggtccgctggccgtattaccgcaaacggtgtttgctcaagatacggctgcacggccctgctacgttttgtaccgccgctgt

SEQ ID NO: 16112 - RNA, 170 nt, unidentified
  source 1..170: mol_type = other RNA; note = Related to JACONZ010000001.1; note = Anaerofilum sp.
catgaacccggcagcaaaaagccgatccggcgccggcagcgagtcgctgccggaacatcgttcttcacaggattcactccgttcaggcggaaccgcttgccgtattcccgcaaacgctgtttgctgaaaatacggctgcgcggcccctctacgctttgtaccggctcatg

SEQ ID NO: 16113 - RNA, 180 nt, unidentified
  source 1..180: mol_type = other RNA; note = Related to CP048436.1; note = Flavonifractor plautii
cacggaacaaaagagaagcccggctcagacgccggagccggccgcgaatcgcggccggtcccgcagactcacgcgtattcgcttcgctccgccgaagcgccgcagcggtatttcagcacacctgcggtgtgcagggggataccgccgcgccgttcgccatacagcaggttttgttccgaa

SEQ ID NO: 16114 - RNA, 190 nt, unidentified
  source 1..190: mol_type = other RNA; note = Related to JAGZAL010000035.1; note = Butyricicoccus pullicaecorum
cataggacaaaagcgtttccgccttttggcgccggcggcgagtcgcccccggttttcgcacacccatccgtattcgctgcgctcagccgcactgctccgcggtattcccgcacattccatgtgcacggcacgccgccggcgtgctgacataccgctccgcagcacgccatacacatggttttgtccccgt

SEQ ID NO: 16115 - RNA, 197 nt, unidentified
  source 1..197: mol_type = other RNA; note = Related to BQNX01000001.1; note = Eubacteriales bacterium
tgcggaacatcagcccttggccaaatcgtttggcgccggcggcgattcgccgccggttcgagaaacctctgcgtattcgctgcgctccagcggcggtgctcgcagtatttctgcacactgcgtgtgctcagggcgcgctgggcgcgcccttcccatactgctgcgcccgcgcaatgcacattttgttttgttccgca

SEQ ID NO: 16116 - RNA, 179 nt, unidentified
  source 1..179: mol_type = other RNA; note = Oscillospiraceae bacterium; note = Related to QALD01000098.1
cgcggaacatcagtctttgtcccgacgttcgggcgccggcggcgagtcgccgccggttgtttgccgcctggttcgaatcgcgtgcgctcacccgccgccgcttgccgtattccaaggcacacgatgtgtgctcctatacggctgcgcggggcgcgatgcgtcatctgtgctgttccgcg

SEQ ID NO: 16117 - RNA, 206 nt, unidentified
  source 1..206: mol_type = other RNA; note = Clostridia bacterium; note = Related to JAFURT010000015.1
gaccggacagtagcgttgattcataattttatgaaagcggtagcgagtcgttaccgttgacctacccagcgtatatgcgtgcaagcacgagaaggcggcttgatgtgaagctgcccacggggggtgggcacacgcatccgacctttggtcggattgcgttttattcacatcggcaccgccgtctatacacacagttctgtccggtc

SEQ ID NO: 16118 - RNA, 175 nt, unidentified
  source 1..175: mol_type = other RNA; note = Related to JAFBIO010000002.1; note = Fournierella massiliensis
aacagagcaatagttttgtcccgacccgggcaccggccgcgagtcgcggccgggatatggatccctggcatattcgctgcgctcaggcgagaccgcttgcggtattccggcacaccctcggtgtgcttaaaaataccgctgcgcggctccccatgcatattggtattgctctttt

SEQ ID NO: 16119 - RNA, 176 nt, unidentified
  source 1..176: mol_type = other RNA; note = Related to NZ_CP044227.1; note = Flintibacter sp.
tggaaagcgatagtttttgtccgtctttggacctcgtccgcgtgtcgcggccgggtttatggattccatcgtattcgctgcgctcaggagaaagcgctggcggtattaccgcacatcgccgatgtgcttcatgataccgctgcacgcttccccatacacatttgtatcgctggaca

SEQ ID NO: 16120 - RNA, 175 nt, unidentified
  source 1..175: mol_type = other RNA; note = Related to JACJJD010000020.1; note = Pseudoflavonifractor sp.
ttcagggcagcaggctctgacctcaattggtccccggccgcgagtcgccgccgggctgcaaaagcttgtcgtattcgctgcgctccggcgaaccatccagcggtataaccgcacaccaaggtgtgctggaagataccgccggacggttccccatacacattggtgctgtccggcc

SEQ ID NO: 16121 - RNA, 175 nt, unidentified
  source 1..175: mol_type = other RNA; note = Related to NZ_CP034413.3; note = Dysosmobacter welbionis
acaggggtgatagctgcagcccctttcgggcgccggccgcgagtcgcggccggttggctggattctggcgtatgcgcttcgcgcaggcgagcccgcttgcggtattggagcacacctgcgatgtgctggaagataccgccgcgcggttccccatacaaatttgtatcgctccgta

SEQ ID NO: 16122 - RNA, 175 nt, unidentified
  source 1..175: mol_type = other RNA; note = Related to NZ_LR130816.1; note = Intestinimonas sp.
tgcggagcggcagtccccgtcccttaccgggcgccggccgcgcgtcgcggccggtcggcagcatccccgcgtattcgctgtgctcaggcgagccgccttgcggtatttccgcacaccggggtgtgcagacagataccgccgcggcgttcgccatacacatttgtaccgcttcgca

SEQ ID NO: 16123 - RNA, 176 nt, unidentified
  source 1..176: mol_type = other RNA; note = Related to NZ_JADCKB010000012.1; note = Ructibacterium gallinarum
gctgaagccgtagtcaagtcatcatgacaccgggcgcgagtcgcgcccggttttttctttattatcgcagattcgctgcgctcaagaaagcggaaaaaccgcattcccgcaaactgcgtttgcaacaaaaaaatgcgccctttcctctttctatgcacattttgtacggcttcagc

SEQ ID NO: 16124 - RNA, 173 nt, unidentified
  source 1..173: mol_type = other RNA; note = Oscillospiraceae bacterium; note = Related to JAGBHD010000062.1
agttaagcattagcgttaattcaacgttgttgaatcgatagcgagtcgttatcgtctaactaaactattatgcattcgcatactcaagaaaattgcttgatgtgtttcagcatatttcatatgcaacaaaaacacatctgcgcaatttcctatactcatagttttgtttaact

SEQ ID NO: 16125 - RNA, 172 nt, unidentified
  source 1..172: mol_type = other RNA; note = Clostridia bacterium; note = Related to JAFXAP010000004.1
agttaaacattagtgttaattcaaccttgttgaaacgatagcgagtcgttatcgcataactaaactattacatattcgtatactcaagtaaattgcttgatgtgtttaagcatatttcatatgcatcgcaacacatcttcacaatttcctatacacaaagttttgtttaact

SEQ ID NO: 16126 - RNA, 171 nt, unidentified
  source 1..171: mol_type = other RNA; note = Candidatus Faecousia intestinavium; note = Related to DVKV01000137.1
gcaggaacaatagccctgcccattttggcaccggcggcgagtcgccgccgggcggcggattttcgcctcattccctgcgttcagacgaagtcctcgcggtattcccgcacacgttccgtgtgctccaagataccgctgcgtcttcgccataccaaatggtattgttcccat

SEQ ID NO: 16127 - RNA, 184 nt, unidentified
  source 1..184: mol_type = other RNA; note = Related to JAFQDF010000039.1; note = Clostridia bacterium
aaatgaacagtagcgttatgtcataattacacctattcaagggtcttatgacaggtaacagcgagtcgctgttgcagatcattaattacaggcaaagatcaatgttgctcgctgtatatttttccaaacagggtttggcgtcatacagcttcacaaattgatatacagattgtactgttcatta

SEQ ID NO: 16128 - RNA, 179 nt, unidentified
  source 1..179: mol_type = other RNA; note = Clostridia bacterium; note = Related to JAFUMW010000045.1
agcaaaacaatagcgttagtcaatttcggcgtttgcggcgagtcgccgcagatatcgcaaacagtcacgtattcgcttcgctcaggcgaaaacgcttgcagtagaacgctgcgcttctatgcactgcgtgcataaaactacagcctcgcgtttcaccatacacattgtattgttttgca

SEQ ID NO: 16129 - RNA, 186 nt, unidentified
  source 1..186: mol_type = other RNA; note = Related to JAFPLT010000171.1; note = Lachnospiraceae bacterium
ccatagacaccagaaacaccgaagctttttttatgctttggaccggttccgagtcggaaccgggaacaggaaaatgagaagcggaacgcaggcgcgttcatcaaaagctccgctgtagattttggcacattccatgtgcaacactacagctccgccttttgatatgcacaaaagtggtgtcttaaa

SEQ ID NO: 16130 - RNA, 177 nt, unidentified
  source 1..177: mol_type = other RNA; note = Related to JAFZQQ010000087.1; note = Oscillospiraceae bacterium
tgtggaacattagcgcgcgtcaacatccgttggcaccgtcagcgagtcgctgccgggatgcagaaccactaggcattcactgcgtgaaatcgcagctactccactgtattacagcccacttcatgggcttaggaatacagctgcgtagctacaatgttctcaatgttttgttccaca

SEQ ID NO: 16131 - RNA, 176 nt, unidentified
  source 1..176: mol_type = other RNA; note = Related to SVKP01000140.1; note = Oscillospiraceae bacterium
cgtgaagcgttagtgtgggtcaacattcgttggcaccggcggcgagtcgccgccgggaggcgggactacagagtattcactgcgtgaaatcgcagccgctcactgtattagcgcccacttcatgggcttgagaatacagcgagacagctgccatattctcactgtattgctccacg

SEQ ID NO: 16132 - RNA, 179 nt, unidentified
  source 1..179: mol_type = other RNA; note = Related to JAFWAC010000028.1; note = Clostridia bacterium
agcggaacattagcgcaagtcaatatctacattggcaccgacagcgagtcgttgttgggatgcatgcttcaaaagcattcacttcgttcattcgaagttgactacactgtatttaagcccactttatgggctaaggatacagcttcgcaacttcgatattctcattgttttgttccgca

SEQ ID NO: 16133 - RNA, 180 nt, unidentified
  source 1..180: mol_type = other RNA; note = Related to JAFQMR010000111.1; note = Clostridia bacterium
tgcgaagcatcagagcaagtcgatccccatcggcaccgaccgcgagtcgcagtcgggatgcaccgcctttaaaccgattcacttcgttcattcgaagacggctccgctgtatggaaacccattgcatgggttcaaaaatacagctttgccgcatcgaaattcacattgtcttgtttcgca

SEQ ID NO: 16134 - RNA, 176 nt, unidentified
  source 1..176: mol_type = other RNA; note = Related to NZ_JACOPN010000001.1; note = Flintibacter sp.
tgtggaacattagcgcaagccagattttattggcaccggcagcgagtcgctgctgggaagcacagcttagtttgattcacttcgttcagcctaatctgctccgctgtataaaaggcacacgccgtgtgcttaaaatacagctgcgcagcttagcattcacattgttttgttccaca

SEQ ID NO: 16135 - RNA, 179 nt, unidentified
  source 1..179: mol_type = other RNA; note = Related to SVSR01000007.1; note = Oscillospiraceae bacterium
agtggaacataagagcaagtcaataaacattggcaccgacagcgagtcgctttcgggaagcagcatttacaagtattcactacgttcagacgaagttgactccgctgtatctaaaaggcccactgcgtgggctataatacagctacacaacatcgtaattcacattgttttgttccacg

SEQ ID NO: 16136 - RNA, 181 nt, unidentified
  source 1..181: mol_type = other RNA; note = Related to JAGBHE010000095.1; note = Clostridia bacterium
tgcagagcattagagcaagccttaatttaacggcgccgatagcgagtcgttatcggaaagcaaatatcaataaatattcactatgttcaaacgaagttgattacgctgtattcgggaagcccactgcatgggcctaaatacagcttcacaacatcgtaatacacatttgtattgctttgca

SEQ ID NO: 16137 - RNA, 178 nt, unidentified
  source 1..178: mol_type = other RNA; note = Clostridia bacterium; note = Related to JAFSXU010000033.1
tgcggaacaatagcgcaggtcaatgttcattggcgtcggcaacgagtcgttgtcggggagtagagtttacaagtattcacttcgttcagacgaagttgactccgctgtataaagatgcccacttcatgggctaaaatacagctacacaacatcgtaattcacaatgtattgtttcgca

SEQ ID NO: 16138 - RNA, 183 nt, unidentified
  source 1..183: mol_type = other RNA; note = Related to JAFYQP010000074.1; note = Clostridia bacterium
aacgggacattagcgcaagtcaatttttaccattggcaccgacggcgagtcgctttcgggatgcagtattcaatgagattcagtaccttcagccgaagcgtgctacattgtataaaaaagcccacgccaggtgggctatgatacaactccgcagcttcgtgatgtacattgttctgttccgta

SEQ ID NO: 16139 - RNA, 176 nt, unidentified
  source 1..176: mol_type = other RNA; note = Clostridia bacterium; note = Related to JAFPRS010000057.1
ttgcggaacatagcgcatgcgttgctttcagcgcgccgtcggcgagtcgccgccggaagccaatatgatcagacgaccgcttcgctcgaacggagcggctccgctgaattgccgcccacttcatgggctataatattcagcttcgcagcccgttctgctcaatgtatgttccgaaa

SEQ ID NO: 16140 - RNA, 178 nt, unidentified
  source 1..178: mol_type = other RNA; note = Related to JAFQUH010000074.1; note = Ruminiclostridium sp.
tgcggaacatcagagcaggtcggtttacatcgacaccggcggcgagtcgccgtcgggaagcagcatttccacctattcacttcgttcacccgaagctgactccgctgtatttatgcccacggtgtgggcaagaaatatacagcttcgcatctgcggattcacattgtcttgttccgcc

SEQ ID NO: 16141 - RNA, 175 nt, unidentified
  source 1..175: mol_type = other RNA; note = Related to JAFQPT010000004.1; note = Oscillospiraceae bacterium
gaacattagagcaagtcaatttccattggcacctgcagcgagtcgctgtggggatgcattaccatgatcgatgcacgcaagtgcaatcgaagctgctgcgctgtatttcagcccactgtcatgggctcgggtatacagcttcgcatcttcggtattcacattgtattgttctgca

SEQ ID NO: 16142 - RNA, 178 nt, unidentified
  source 1..178: mol_type = other RNA; note = Related to JAFUPP010000033.1; note = Clostridia bacterium
cacggaacataagcgcaggtcaattatcattggcaccgacagcgagtcgcggtcgggacagcaatatcagtatagtttcgctttgctcaagcgaatctgtttaagcagtatttaagcccacatacatgggctcagtatacagctacacatcttcgtattcacattgttttgttccgta

SEQ ID NO: 16143 - RNA, 179 nt, unidentified
  source 1..179: mol_type = other RNA; note = Related to JAFPOZ010000331.1; note = Clostridia bacterium
tgtgaggcattagtgaacgtcaatttcttgacagctgcggcgagtcgctgcggtcagacatatacctttgatagtcgcttcgctccggagaagctgactgcgcagtatacgggcccatgttccatgggctggaggatactgcttcgcatcttctcgatgcgcattagtattgcctcaca

SEQ ID NO: 16144 - RNA, 180 nt, unidentified
  source 1..180: mol_type = other RNA; note = Clostridia bacterium; note = Related to JAFZOL010000002.1
ggcggaacgtaagcgcagacccgtttttttacggcgccggccgcgagtcgcggtcggtacgcggcatccccgcaggattcgcttcgctcaatcgcgttcgcttcgctgtattgcagcccgcttcacgggctcagagatacagctcgcaacggcgatatgctttttcagttacgttccgcg

SEQ ID NO: 16145 - RNA, 181 nt, unidentified
  source 1..181: mol_type = other RNA; note = Clostridia bacterium; note = Related to JAFURU010000174.1
aacggaacataagagcaagtcaatatacgttggcaccgtgggcgggtcgccctcgggaagcaggcaaaagatacggggctcacttcgttcggacgaaagcggctaagcagtatgaaaatgcccaccttgtgggcccgaatactgcaccgcgcttccgtgattcacattgttttgttccgta

SEQ ID NO: 16146 - RNA, 176 nt, unidentified
  source 1..176: mol_type = other RNA; note = Related to JAFTEJ010000045.1; note = Clostridia bacterium
tgtggaacactagagcaagtcaatcatcattggcaccggcagcgagtcgctgtcgggaagcatttcaacgaggggctcgcttcgctcgatcgaagctgcttcactgtgttttggggcccacgttgtgggcttaaacacagctcacatcttcgagatacacactgttctgttccaca

SEQ ID NO: 16147 - RNA, 177 nt, unidentified
  source 1..177: mol_type = other RNA; note = Related to JAFQEI010000172.1; note = Clostridia bacterium
tacggaacattagcgcgagccggttttcacaggcaccgacagcgagtcgccgtcgggatgcagtatccatcaggattcacttcgttcaaccgaagctgattccgctgtatttcagcccacttcatgggcttgggatacagctgcacatcttcgtgatccacattgttttgttccgtg

SEQ ID NO: 16148 - RNA, 167 nt, unidentified
  source 1..167: mol_type = other RNA; note = Related to JAGAYD010000015.1; note = Butyrivibrio sp.
tgcggaactctagcgcagctggcaaacgtcggcacgagtggcgagtcgttactcggaaaagaactatgtagcattataattgtagctgttccactgtagtgaaatgcacgcttcacgtgctagactacagctccacagcaacaatattcttactgttttgttccgca

SEQ ID NO: 16149 - RNA, 167 nt, unidentified
  source 1..167: mol_type = other RNA; note = Related to FOXO01000040.1; note = Butyrivibrio proteoclasticus
agcggaactctagcgtagtcaacaaacgttggcacgagtagcgagtcgttactcggaaaagatatttgtaacattataatagcagctgttccactgtagtaggaggcacgcttcacgtgctaaactacagctccacagcagcgatattcttactgttttgttccgct

SEQ ID NO: 16150 - RNA, 168 nt, unidentified
  source 1..168: mol_type = other RNA; note = Related to JAGBKD010000016.1; note = Eubacterium sp.
agcggaactctagtgtagtcggcatacgtcggcacgaatgacgagtcgttattcggaaagagtgattagtaccattttaattgcagctgtttcactgtagcaggaggcacgcttcacgtgcttaactacagctccgcagcagcgatattcttactgttttgttccgct

SEQ ID NO: 16151 - RNA, 169 nt, unidentified
  source 1..169: mol_type = other RNA; note = Lachnospiraceae bacterium; note = Related to JAFOYD010000138.1
aacggaactttagtgcagtcagctgacgttgacacggacagcgagtcgttgcccggaagtaaatcctgattacattattatcgccactgctccaacgtagttttgggcacgctgccacgtgcttctctacgcctgcgcagtagcaatattctaactgtattgttccgga

SEQ ID NO: 16152 - RNA, 180 nt, unidentified
  source 1..180: mol_type = other RNA; note = Related to FOWB01000004.1; note = Pseudobutyrivibrio sp.
tgtagaactatagtgcagtcaacttacgttggcacgagcagcgagtcgttgttcggatgtatatcatagtttgttttaatagatactgctccaacgtagtggaggcacgccgaagtgtaccacttcaacgtgctgctctacgcctacgcagcatcgatattcttactgtatggttctacg

SEQ ID NO: 16153 - RNA, 178 nt, unidentified
  source 1..178: mol_type = other RNA; note = Related to JAFQLL010000109.1; note = Clostridia bacterium
aacggagcattagtgtatgtcaattttaattggcaccgacagcgagtcgttgtcgggacaagttaagtaaaagtattcgcgcactcagctgaaacagctgtgactgtataaaaatgcccacttcatgggctcatatacagccacatcagcttcatgattcgcattgttttgctccgta

SEQ ID NO: 16154 - RNA, 172 nt, unidentified
  source 1..172: mol_type = other RNA; note = Related to JAFUOO010000022.1; note = Clostridia bacterium
aacggagcattagtgtaagcctattggcaccgacagcgagtcgttgtcgggacaaggttagtaaaagtattcacgagttcagctgaaacagctgtggcagtataaaaaggcccacttcatgggctcatatacagccacatcagcttcatgattcgcattgttttgctccgta

SEQ ID NO: 16155 - RNA, 177 nt, unidentified
  source 1..177: mol_type = other RNA; note = Clostridia bacterium; note = Related to JAFXHP010000039.1
agcagagcattagtgtatgtcaaaccttgtttgacgcctcgggcgagtcgccccgggttacataaaaataaaaaaagtcacttcgttccatccatgtggtgccgctgtaatattgcccacttcatgggccgaaagttacagcttaccacaaaagattttctcatgttttgctctgcg

SEQ ID NO: 16156 - RNA, 203 nt, unidentified
  source 1..203: mol_type = other RNA; note = Related to JAFYHQ010000006.1; note = Erysipelotrichaceae bacterium
agcagaacatcagtcataatcgatgcaggcattacctgccgataccgtcagcgagtcgctgccgggaaatgaaaaccaagctcaattgcttcgcaaatgagttgtctcggaagcaggtcactacactgcgttcgttcacgaactcactccatgtagattcctactgcatcctcgaaactcatattctcaagtcttgttctgct

SEQ ID NO: 16157 - RNA, 212 nt, unidentified
  source 1..212: mol_type = other RNA; note = Erysipelotrichaceae bacterium; note = Related to JAFRKA010000015.1
agcagaacatcagtcatgttcgatgaggagaccacaagtcaatcaagtcgataccgtcagcgagtcgttgccgggatatgaaaacttaattaatttgcttcgcaaatgaattgtctcggaagcattaaactacactccgttcgttctcgaactcactccatgtagacgcttcatgctccctcgaaattcatatactcaagtcttgttctgct

SEQ ID NO: 16158 - RNA, 203 nt, unidentified
  source 1..203: mol_type = other RNA; note = Erysipelotrichaceae bacterium; note = Related to JAFYHQ010000014.1
agcagaacatcagccatgatcggcgtaggtttgatcccgccgtaccgtcagcgattcgttgccgggaaatgaacacacagtattcttgcttcgcaaatgggttgtctcggatgtaggtttgtacactccgttcgttcacgaactcactccatgtacctcactactacaccctcgaaacccctattctcaagtcttgttctgct

SEQ ID NO: 16159 - RNA, 211 nt, unidentified
  source 1..211: mol_type = other RNA; note = Related to JAFRQF010000031.1; note = Erysipelotrichaceae bacterium
agcagaacatcagtcatattcgatgagaagaattatttcaatccttgtcgataccgtcagcgagtcgttgccgggatatgagcatcaatcatcattgcttcgcaaagaagttgtctcggaagcaggtaactacactgcgttcgttcacgaactcactccatgtagcccctgctgcatcctcgaaacttctattctcaagtcttgttctgct

SEQ ID NO: 16160 - RNA, 174 nt, unidentified
  source 1..174: mol_type = other RNA; note = Related to JAFUCV010000276.1; note = Solobacterium sp.
tgcagaacagcagcgcagttcatcttcacgatgacaccgtatgcgcgtcgcatacgggatgcacataaccgatacagtcacatgttccattccggtactgcactgcagtgagagcacacttcatgtgccatcctgcaattccgtatccgaaatattctcaggtgctgttctgct

SEQ ID NO: 16161 - RNA, 189 nt, unidentified
  source 1..189: mol_type = other RNA; note = Related to DS264270.1; note = Eubacterium ventriosum
tgcagtgcattagtgcatttcaattttatattgaagtcaatagggagtcgctattgatagttattaatacagtttgtattcgataaaatcgaatacaccatagaatctttgctcgatgtaggtggagcacattacatgtgctagactacatctgcgccagtttctaaattctcaatgttttgcattgca

SEQ ID NO: 16162 - RNA, 176 nt, unidentified
  source 1..176: mol_type = other RNA; note = Related to JAFTAK010000098.1; note = Clostridia bacterium
gccgaacatcagagcaagccaactaacgtcggcacccgcggcgagtcgccgcggggaagcatcaaccctgatccgcgcctgcggcgcgctcacagccgctccgctgtatgaattgcccactaccatgggctgtaatacagctccgcgcctgagaattcacactgtcttgcttcggc

SEQ ID NO: 16163 - RNA, 189 nt, unidentified
  source 1..189: mol_type = other RNA; note = Related to SVBR01000043.1; note = Erysipelotrichaceae bacterium
cggattgcaccagtgtgatccggttttggccggtaccgtcagcgagtcgctgccgggatacagtttggccagggttcgccttcggctcaattcctgatgctcgcagcagaacagcacacgtcccgtgtgcacgcccttacgggctgccctgcagctgcgcttcagaatattctcaagtggtgtcagaag

SEQ ID NO: 16164 - RNA, 193 nt, unidentified
  source 1..193: mol_type = other RNA; note = Related to JAFUHN010000140.1; note = Solobacterium sp.
gaaaacgcaccagcgttactccggcaatgccggtaccgtcagcgagccgctgccgggatgacagtccgctgaagcttcgccttcagctcaattcctgatgctcgccgcagtacagcacacgtcccgtgtgcacgccccgtaaaggggctgaactgctgctgcgcttcagaatattctcaagtggtgcagtaaa

SEQ ID NO: 16165 - RNA, 175 nt, unidentified
  source 1..175: mol_type = other RNA; note = Erysipelotrichaceae bacterium; note = Related to DPVX01000340.1
aaaacagcaccagcgtaacgtcattgcaaaatgacaccgtcagcgagtcgctgccgggatacgaaaacataaaatatgcgcatggcgcagttcctgtgctcgcagcagtacagcccatttcatgggtcccggaactgcagctgcgcgcagaaacattcgcaagtggtgctttgga

SEQ ID NO: 16166 - RNA, 189 nt, unidentified
  source 1..189: mol_type = other RNA; note = Related to JAGCGE010000004.1; note = Clostridiales bacterium
agcagagcaatagagcaagtcagctaattactgacgccggccgcgagtcgcagtcggagaagaaccaccgaggagtaagtaacgtgaacgttacttacaggtatcgaatcttcttcaatgaataagaattaacttcgttaatgtaaattcacttcagaatcttcgatattgatattgtattgttctgcg

SEQ ID NO: 16167 - RNA, 138 nt, unidentified
  source 1..138: mol_type = other RNA; note = Related to JAFWKC010000096.1; note = Eubacterium sp.
cagtcggcggcagaagattgaaatgacgtgttttcgtttcaggcgagtgcgagtcgtgctcgttaaataaaagtccaacaaagcgatgaacattagcattgcttcgcaatgcaaactatactcaggtgccgccggctg

SEQ ID NO: 16168 - RNA, 138 nt, unidentified
  source 1..138: mol_type = other RNA; note = Oscillospiraceae bacterium; note = Related to DOBY01000149.1
aggtcggcggcagcagatttaagtaatctttttacttaaggcaggagcgagtcgctgctgttaaacaaatttatttcgtgtgccgaatgcctcgtgcaatttcattgcacaacaaataacactaagtgccgccgaccg

SEQ ID NO: 16169 - RNA, 126 nt, unidentified
  source 1..126: mol_type = other RNA; note = Related to SVKT01000009.1; note = Oscillospiraceae bacterium
agacgaagcgtagcctttgcttgattacgatccgctcgagcaggtgtggcgagtcgccacgctacgacagtatttgtgaacgatgcgcgaatcccttcgcgctaccttcggcagtacgcttcgtct

SEQ ID NO: 16170 - RNA, 126 nt, unidentified
  source 1..126: mol_type = other RNA; note = Oscillospiraceae bacterium; note = Related to JAFXTM010000067.1
gcggtgaagatagcgtaattcctgccatcgcgcggggagagcagcgagtcgctgttctgttttttaagcccgacacccgaatctgcttcgcaattcggcactgaagaataaaggtgtcttcaccgc

SEQ ID NO: 16171 - RNA, 150 nt, unidentified
  source 1..150: mol_type = other RNA; note = Oscillospiraceae bacterium; note = Related to JAFTYM010000022.1
cagggagcggcagccgcgctttcttccgtaaaaagatgagggcaaggtgggcgagtcgccctccgtgagcttaattcagtgaggtccgcaaacgtacccgtttgcgctctcaagcttcgcttgagacattaatttttgtgccgcttcctg

SEQ ID NO: 16172 - RNA, 151 nt, unidentified
  source 1..151: mol_type = other RNA; note = Oscillospiraceae bacterium; note = Related to JAFQMH010000077.1
cagggagcggcagccgcgctttcttcccaaaaagctgaaagtaaggtgggcgagtcgccctccgagagattttttgagtgaggtccgcaaacgtttaccgtttgcgctctcaagctacgcttgagacaacagatttttgtgccgcttcctg

SEQ ID NO: 16173 - RNA, 174 nt, unidentified
  source 1..174: mol_type = other RNA; note = Related to NZ_LT835157.1; note = Proposed Anaeromassilibacillus sp.
gacggaacaacagcgctaaccatgtgatgcatacatggctggacggcgagtcgccctccagaaagatgactttggaaaaagaggcatgcggccttcgccgtgtcaagatacacaaggtgtattcccacacggctatgcccgcatcccttcaggaacaatttgtgttgttccgtc

SEQ ID NO: 16174 - RNA, 177 nt, unidentified
  source 1..177: mol_type = other RNA; note = Related to NZ_JADNJD010000005.1; note = Proposed Anaeromassilibacillus sp.
ggcgggacaacagcgctttccgtggccattgtcagcacggctggccggggagtcgccggccaataggatatctgggcagaaagaggcatgcgggattcgccgtgtaatcgatacactgcgtgtattcccacacggctgtgcccgcatcccttcaggtgtttgatgtgttgccccgcc

SEQ ID NO: 16175 - RNA, 176 nt, unidentified
  source 1..176: mol_type = other RNA; note = Proposed Anaeromassilibacillus senegalensis; note = Related to NZ_LN868536.1
gacggggcaatagcgtcttccgcctcccgcgcggcagcccggcgagtcgccgggccggacagtcattcccgattccgggagaaaaacaagcctcgccgtgttccggatacactgcgtgtatcaatagacacggctgcggttgcatttctaaatgaagttttttgtattgccccgtc

SEQ ID NO: 16176 - RNA, 192 nt, unidentified
  source 1..192: mol_type = other RNA; note = Related to CP042469.1; note = Clostridiales bacterium
acgaaagcgatagcgaatcttacagagacactctctgtgagcgggcgttgagtcgacgcctgtatcccgaaatccgaagatcgcagcctgcggcagcgataaaaattctgtcctcaccgtgctctggctacatttcatgtaggtctgcacggctgtgggtgaattttacgagagtttttgtatcgctttcgt

SEQ ID NO: 16177 - RNA, 185 nt, unidentified
  source 1..185: mol_type = other RNA; note = Related to VFMF01000001.1; note = Clostridium sp.
gcggaaacggcagcagattctgcggatttttttcgcaggaggacggcgagtcgccgcccccgaaagggtaaaaggacctgcgctgcgcgcgcagaaagcaatcctcaccgtgtaaccatacacttcatgtattttaaaacacggctgcggttgcattccgaaggaagattttgtgccttttccgc

SEQ ID NO: 16178 - RNA, 161 nt, unidentified
  source 1..161: mol_type = other RNA; note = Related to JAFXOM010000274.1; note = Oscillibacter sp.
ggcggggcggcagtctacaccgcgcttccacgtgcgggcgtccgcgagtcgcggccgcagcttattctcccgtcactttgtcgcgttccacgctccggttccttcggaaccccgttccttgcggaacgcagcttcgctgtctttttttgtgccgccccgcc

SEQ ID NO: 16179 - RNA, 136 nt, Flavobacterium sp.
  source 1..136: mol_type = other RNA; note = Related to NZ_QNVY02000005.1
ttaaaagaaatttgttggcttatgctagcgacggaaccgtgagtcactgttctgtaattgaatgttctttcaagcaccaggtttaaaagattctccgcagagctccgaacttttaaaccggtattcttaattgggg

SEQ ID NO: 16180 - RNA, 136 nt, Flavobacterium sp.
  source 1..136: mol_type = other RNA; note = Related to NZ_SMFN01000003.1; note = Flavobacterium sandaracinum
ttaaaagaaatttgttagcccaggttagcgatggagccgtgagtcactgttctgtaattgaatgttctttcaagcaccaggtttaaaagattctccgcagagctccgaacttttaaaccggttttcttaattggga

SEQ ID NO: 16181 - RNA, 136 nt, Flavobacterium sp.
  source 1..136: mol_type = other RNA; note = Related to NZ_FODN01000006.1; note = Flavobacterium sinopsychrotolerans
ttaaaataaatttgttagccctggttagcgacggagccgtgagtcactgttctgtaattgaatgttctttcaagcaccaggtttaaaagattctccgcagagctccgaacttttaaaccggttttcttaattggga

SEQ ID NO: 16182 - RNA, 135 nt, Flavobacterium sp.
  source 1..135: mol_type = other RNA; note = Related to NZ_SMLH01000005.1; note = Flavobacterium ranwuense
tcaaagaaatttgttagcccaggttaacatcggagccgtgagtcactgctctgtaattgaatgttctttcaagcaccaggtttaaaagattctccgcagagctccaaacttttaaaccggtattcttaatcgggg

SEQ ID NO: 16183 - RNA, 135 nt, Flavobacterium sp.
  source 1..135: mol_type = other RNA; note = Related to NZ_JQMS01000001.1
tcaaagaaatttgttagtctaggctagcgacggaaccgtgagtcactgttctgtaattgaatgctctttcaagcaccaggtttaaaagattctccgcagagctccgaacttttaaaccggtattcttaatcgggg

SEQ ID NO: 16184 - RNA, 135 nt, Flavobacterium sp.
  source 1..135: mol_type = other RNA; note = Related to NZ_JSYM01000001.1
ccaaagaaatttgctagtttaggctagcgacggagctgtgagtcactgttctgtaattgaatgctctttcaagcaccaggtttaaaagattctccgcagagctccgaactttcaaaccggtattcttaattgggg

SEQ ID NO: 16185 - RNA, 133 nt, Flavobacterium sp.
  source 1..133: mol_type = other RNA; note = Related to NZ_SMFM01000002.1; note = Flavobacterium caseinilyticum
ctagaaataaatttgtttacgttagaatcggagccgtgagtcactgctctgtaattgaatgttctttcaagcaccaggtttaaaagattctccgcagagctccgaacttttaaacctgtattcttaattgggg

SEQ ID NO: 16186 - RNA, 133 nt, Flavobacterium sp.
  source 1..133: mol_type = other RNA; note = Related to NZ_QKXH01000002.1; note = Flavobacterium aquariorum
tcccaaagagctgttagtgtaggctaacaacggagccgtgagtcattgctctgtaattgaatgctttttcaagcacaggctttaaaagatctccgcggagctacgaccttttaaacctgtttcttaattgggg

SEQ ID NO: 16187 - RNA, 134 nt, Flavobacterium sp.
  source 1..134: mol_type = other RNA; note = Related to JAHWYN010000011.1
ccataaagagctgttagtatgttactaacaacggagccgtgagtcactgctctgtaattgaatgctttttcaagcacaggctttaaaagatcttcgcagagctacgaccttttaaacctgtttcttaattggga

SEQ ID NO: 16188 - RNA, 136 nt, Flavobacterium sp.
  source 1..136: mol_type = other RNA; note = Related to JAGGNA010000001.1
ctcaaacagttcatttagctgaggctaatgacggagccgtgagtcactgttctgtaattgaatgctttttcaagcaccaggtttaaaagattctgcgcagagctccgaacttttaaaccggtattcttaattgggg

SEQ ID NO: 16189 - RNA, 136 nt, Flavobacterium sp.
  source 1..136: mol_type = other RNA; note = Related to NZ_FRCL01000005.1; note = Flavobacterium xinjiangense
ctcaaagaactcacatagccttggctagtgacggaaccgtgagtcactgttctgtatttgaacgctttttcaagcactaggtttaaaagatcctccgcagagctccgaacttttaaaccggtattcttaattgggg

SEQ ID NO: 16190 - RNA, 135 nt, Flavobacterium sp.
  source 1..135: mol_type = other RNA; note = Related to NZ_FOFZ01000005.1; note = Flavobacterium frigoris
tttaaagattgtgttagctcagctaacatcggagcagtgagtcactgttctgtaattgaatgctttttcaagcactgggtttaaaagatcctccgcagagctccgaaccttttaaacccgtattcctaattggag

SEQ ID NO: 16191 - RNA, 135 nt, Flavobacterium sp.
  source 1..135: mol_type = other RNA; note = Related to NZ_FNMV01000002.1; note = Flavobacterium degerlachei
tttaacgattttgttagcttagctaacatcggagcagtgagtcactgttctgtaattgaatgctttttcaagcactgggtttaaaaggccctccgcagagctccgaaccttttaaacccgtattcctaactggag

SEQ ID NO: 16192 - RNA, 134 nt, Flavobacterium sp.
  source 1..134: mol_type = other RNA; note = Related to NZ_PVUB01000001.1; note = Flavobacterium granuli
tctaaagattgtgttagctcagctagcgtcggagccgtgagtcactgttctgtaattgaatgttctttcaagcactggtttaaaaggctctacgcagagctccgaaccttttaaacccgtattcctaatgggag

SEQ ID NO: 16193 - RNA, 136 nt, Flavobacterium sp.
  source 1..136: mol_type = other RNA; note = Related to NZ_JADHEC010000014.1; note = Flavobacterium soyangense
ttccaagatttcatcagcattagctgatgaggagtcgtgagtcacaactctgtaattgaatgctttttcaagcaactatgtttaaaaggatctccgcagagctccgaaccttttaaacccgtgttcttaactggag

SEQ ID NO: 16194 - RNA, 136 nt, Flavobacterium sp.
  source 1..136: mol_type = other RNA; note = Related to PNNA01000057.1
cctgaaaatttcatcgacagtggtcgatgaggagtcgtgagtcactactctgtaatggaatgctttttcaagcaactgtgtttaaaaggatctccgcagagctccgaaccttttaaacccgtgttcttaactggag

SEQ ID NO: 16195 - RNA, 138 nt, unidentified
  source 1..138: mol_type = other RNA; note = Related to NZ_QNUG01000026.1; note = Epilithonimonas hispanica
ttaaaatattgtgatggtttcgaccacacctgagccgtgatgtcattgctcagtaattgaataggctttcaagccttcgtgtttaaaaggattccgctgaagctccacccttttaaacccgtattcactaatttgagt

SEQ ID NO: 16196 - RNA, 139 nt, unidentified
  source 1..139: mol_type = other RNA; note = Bacteroidetes bacterium; note = Related to JACPUU010000004.1
ttaaaataacgtgtcggtttcggccggcacctgagttgtgagtcactgctcagtaattgaatgggctttcaagctttcgggtttaaaaggggttccgctgagctccaccccttttaaacccgtattcactaatttgagc

SEQ ID NO: 16197 - RNA, 139 nt, unidentified
  source 1..139: mol_type = other RNA; note = Related to NZ_FTOB01000002.1; note = Zobellia uliginosa
tcaaaatattgtatcagtttcggctgataccggagccgtgagtcactgctctgtaattgaatgggctttcaagctctcgggcttaaaaggggttccgcagagctgcaccccttttaagcccgtattcactaatttgagt

SEQ ID NO: 16198 - RNA, 139 nt, unidentified
  source 1..139: mol_type = other RNA; note = Related to NZ_AMGM01000138.1; note = Cecembia lonarensis
ttaaaatattgtgttgacttcggttggcaccggagcagtgagtcactgttctgtaattgaatgggttttcaagccttcgggtttaagcggggttccgctgaggctccaccccgcttaaacccgtattcactaattgagt

SEQ ID NO: 16199 - RNA, 138 nt, unidentified
  source 1..138: mol_type = other RNA; note = Related to NZ_CP083760.1; note = Candidatus Sulfidibacterium hydrothermale
taaaagttttgtgttggctgtgctaacaccggaatagtgagtcactattctgtaatggaatgggctttcaagccttcgggtttaaaagggctgccgctgaggctccagcccttttaaacccgtattcactaacttgag

SEQ ID NO: 16200 - RNA, 138 nt, Flavobacterium sp.
  source 1..138: mol_type = other RNA; note = Related to NZ_MUHA01000018.1; note = Flavobacterium oncorhynchi
taaatagtttgtgttaatgtaaattaacaccggagccgtgatgtcactgttctgtaattgaatgctttttcaagccataaaattttaaagcttctccgcagagctcctaagctttaaaatttttattcatatttgagt

SEQ ID NO: 16201 - RNA, 139 nt, Flavobacterium sp.
  source 1..139: mol_type = other RNA; note = Related to MQTN01000055.1
taaataattagtggcatcaatataattgatgttgggtcaatgagtcattgccctgtaagtgaatgctttttcaagcatgcgataacaaatttcctcaaaaggatttgagaaaatttgttatcgctattcctaatttgag

SEQ ID NO: 16202 - RNA, 138 nt, unidentified
  source 1..138: mol_type = other RNA; note = Chitinophagaceae bacterium; note = Related to JADJAG010000004.1
ttgagatacttcttcaacttcggctgaagacggagcagtgagtcactgttctgtaaatgaatgggctttcaagcatcagggcgaaaagcttctccgccagagctccgaagcttttcgccctgtatcgataatttgagt

SEQ ID NO: 16203 - RNA, 124 nt, Citrobacter sp.
  source 1..124: mol_type = other RNA; note = Related to QFQQ01000035.1; note = Citrobacter freundii
tcattctgacttgcctttaggccggcttggcgagtcgtcaagctgtaagagaataacctttcgagctgtggggggtgtgacggtccgcaagtttcgctccgctgcgctacgctcaacattgcgc

SEQ ID NO: 16204 - RNA, 150 nt, unidentified
  source 1..150: mol_type = other RNA; note = Related to NZ_UGYW01000002.1; note = Sphingobacterium spiritivorum
gtaaagttatttatatcatttataaggtgtagcgagtcgttatgctgtagaagaatgaactttcaagcttacaggtggaaagaagcgtcaaagtttgcctcgttcctcagcaaacatttgccacttctttccacctttgtcgataggctc

SEQ ID NO: 16205 - RNA, 156 nt, unidentified
  source 1..156: mol_type = other RNA; note = Related to NZ_JAFEWD010000003.1; note = Pedobacter sp.
tgaaagagttttccgtttaggataaagaaactgggtggtgagttcacctccccggatggtgaatagcttttcaagcttggaagcgaacaagaggaaccgaaagcctcctccgtgcctcccccggcatttcgctccctcttgttcgctttgttcaaa

SEQ ID NO: 16206 - RNA, 159 nt, unidentified
  source 1..159: mol_type = other RNA; note = Related to JACHBZ010000008.1; note = Mucilaginibacter sp.
acagaagatatgcctggtgtattccaggagggatgatgagttcgtcattcccagttgagaaaaggctttcgagccttagcgacaaacataaaccgggagcctccgcctacggcctgcccccggcatcccgcttcatgtttgccgctttgttcaatgggc

SEQ ID NO: 16207 - RNA, 164 nt, unidentified
  source 1..164: mol_type = other RNA; note = Related to BMHZ01000001.1; note = Pedobacter zeae
tctgaagaaattgctctagtattctagaagccggaagggtgtagtcacctattctgtaagtgaacaggctttcaagcttgtgcattaaacataaatcaaaagtctccccctaaagggctccgccgacattttgcttcacgtttaatgcattgttttaatggggc

SEQ ID NO: 16208 - RNA, 162 nt, unidentified
  source 1..162: mol_type = other RNA; note = Related to NZ_FOAF01000001.1; note = Olivibacter domesticus
ttaaaataattcccccggttttccggggcgggtggatgttgtcatcccccttgtaagtgaacaggctttcaagcttgtggattaaacataaaccaaaagtctcctccccaaaggggcccctccgacattttgcttcatgtttaatccattgtttaaaggagc

SEQ ID NO: 16209 - RNA, 166 nt, unidentified
  source 1..166: mol_type = other RNA; note = Related to QGTG01000019.1; note = Chitinophaga sp.
taaaataattgctctagtgtgtctagaagccggagggatggagtcatcctctctgtaagagaacaggctttcaagcttgtgcattaaacgtaaatcaaaagtctccttccccagaggggccccttccgacattttgattcacgtttaatgcattgtttaagatggg

SEQ ID NO: 16210 - RNA, 139 nt, unidentified
  source 1..139: mol_type = other RNA; note = Related to NZ_CP094326.1; note = Zhouia spongiae
ccaaacggagcttgatttttaaaagaaatggctggtgaagtcacctgtccaaatagtgaaccttctttcaagctagcgaattttgaaaaggcaaaatcggagatatttccctttccaaaattcttattccgaacggggg

SEQ ID NO: 16211 - RNA, 138 nt, unidentified
  source 1..138: mol_type = other RNA; note = Related to NZ_VTZS01000003.1; note = Pareuzebyella sediminis
ccaaacagagcttgatttttaaagaattggttggtgaagtcaccattccaaatagtgaacattctttcaagctagcgaattttgaaaaggcaaaatcggagatatttcccttttcaaaattcttattccgaacagggg

SEQ ID NO: 16212 - RNA, 140 nt, unidentified
  source 1..140: mol_type = other RNA; note = Related to NZ_AFPB01000170.1; note = Aquimarina agarivorans
ccagacagagcttgatttttaaaagaaatggttggtgatgtcaccatgccaaatagtgaacattctttcaagctggcgaattttgaaaaggcaaaatcaatagatatttccctttccaaaattcttattccgaacggggg

SEQ ID NO: 16213 - RNA, 147 nt, unidentified
  source 1..147: mol_type = other RNA; note = Related to NZ_AFXZ01000051.1; note = Bizionia argentinensis
tcaaacagagcttgatttttaaaacttcaaaaaaaatggtcggtggtgtcacctttccaaatagtgaatattctttcaagcaagcgaattttgtaaagacaaaatcagagatatttgcctttacaaaattcttattccgaacggggg

SEQ ID NO: 16214 - RNA, 150 nt, unidentified
  source 1..150: mol_type = other RNA; note = Related to NZTP01000067.1; note = Proposed Altibacter sp.
tcaaaatgcacttgatttttgaatccaaaaataaaatgggtagtgaggtcactttcccaattagtgaacttagtttcaagcttataagtgcttataagaagttaaaatcggagattattaacttcttaacgcacttattccgaacggggg

SEQ ID NO: 16215 - RNA, 151 nt, unidentified
  source 1..151: mol_type = other RNA; note = Related to JABXHT010000059.1; note = Tenacibaculum sp.
tcaaaatgaaattcatttttgaatcctaaagaaattggatggtgacgtcacctacccgtatagtgaacataatttcaagcttaaggagcttttaaaatttaaaatccagtaggtatttaaatttcaaaatctcctttattccgaacggggg

SEQ ID NO: 16216 - RNA, 148 nt, unidentified
  source 1..148: mol_type = other RNA; note = Crocinitomicaceae bacterium; note = Related to PAVO01000044.1
tcaaaatgaaatccatttttagctcaataaaattcgggtggtgatgtcaccgacccttgttgagaacattatttcaagcttaagcagcttttaaaatttaaaatcagagatatttaaatttcaaatgctgctttattccgaacggggg

SEQ ID NO: 16217 - RNA, 153 nt, unidentified
  source 1..153: mol_type = other RNA; note = Related to NZ_JADPVI010000001.1; note = Kaistella gelatinilytica
ccaaaataaattaaatttttaatttaataagggcagtgattcactcgtccctaccttgggaacaaaatttcaagcttaacgagctttagctcattgaaatcttcccaaaacctcagaatttcaatgagctaaatctcatttttccgtttggga

SEQ ID NO: 16218 - RNA, 152 nt, unidentified
  source 1..152: mol_type = other RNA; note = Related to NZ_JAELVM010000001.1; note = Chryseobacterium endalhagicum
ccaaagcaaaatctttttttaaaaatatggggatgtgatgtcacataccctgatttgggaacataatttcaagctcaatgagcttgtaataaagcaaaatctccgctctgctacgatatttgctttattaaagctcatttttccgtttggga

SEQ ID NO: 16219 - RNA, 144 nt, Flavobacterium sp.
  source 1..144: mol_type = other RNA; note = Related to CP013992.1; note = Flavobacterium covae
ccaaaatgaattatatttttaatgtaatatatgggaagtgagtcactaaccctaaattgggaactaaatttcaagctcaatgagcttgtaaataagcaaaatcaaagatatttgcttatttaaagctcatttttccgtttggga

SEQ ID NO: 16220 - RNA, 142 nt, unidentified
  source 1..142: mol_type = other RNA; note = Related to NZ_FWXS01000003.1; note = Moheibacter sediminis
ccaaaataaattatatttttaatataatatgggatgtgagtcactaacccttatttgggaactaaatttcaagctcaatgagcttgtaactaagcaaaatctccgatatttgcttagttaaagctcatttttccgtttggga

SEQ ID NO: 16221 - RNA, 145 nt, unidentified
  source 1..145: mol_type = other RNA; note = Related to CP040516.1; note = Elizabethkingia miricola
ccaaaataaattatttttttaaattaatataatgggaagtgagtcactaacccttatttgggaactaaatttcaagctcaatgagcttgtaactaagcaaaatctacgatatttgcttagttaaagctcatttttccgtttggga

SEQ ID NO: 16222 - RNA, 144 nt, unidentified
  source 1..144: mol_type = other RNA; note = Related to NZ_CP075682.1; note = Chryseobacterium sp.
ttaaaagaattatctttttaaaaatattgggatgagatgtcttctaccccttattgggaacttattttcaagctcaatgagcttataacgtaacaaaatccagtaggtatttgttccgttaaagctcatttttccgctatggga

SEQ ID NO: 16223 - RNA, 153 nt, unidentified
  source 1..153: mol_type = other RNA; note = Related to CACSGR010000184.1; note = Tenacibaculum maritimum
tagaaatgaacttcatttttaataaagaattaaggatggtgagtcacctacccagttagagaacgttctttcaagctaaacaaggcttgcaaagatttaattgatgaaaaatcaatataaatcttcacaatccttgtttattccgaacggggg

SEQ ID NO: 16224 - RNA, 146 nt, unidentified
  source 1..146: mol_type = other RNA; note = Related to NZ_CP058984.1; note = Polaribacter sp.
tagaaatgaacttcatttttgataaagaataaggatggttagttacctacccaattagagaacattctttcaagctaaacaaggcttcacaaagatttaatcaaagatataaatcttcgcaaatccttgtttattccgaacggggg

SEQ ID NO: 16225 - RNA, 146 nt, unidentified
  source 1..146: mol_type = other RNA; note = Related to NZ_JPJI01000026.1; note = Nonlabens ulvanivorans
ccaatagaaaagaacttgatttttagaattctgaatggtgagtcaccatttatttagagaacttactttcaagcaaaacaacttaaaataaagattcaatccgtaggtattcatcttttttttaagttgttttatcagaacggggg

SEQ ID NO: 16226 - RNA, 137 nt, unidentified
  source 1..137: mol_type = other RNA; note = Related to JAGGDU010000099.1; note = Trichodesmium erythraeum
tttatggaagtttaggtaaatttgtcgaaggtggcgaggtcgccatctgtttgagaacttgctttcaagctgtatcgtgtaaataaagggaaaatcaaagatatttccctttatttacactccatttatcgcgaaag

SEQ ID NO: 16227 - RNA, 134 nt, unidentified
  source 1..134: mol_type = other RNA; note = Related to NZ_RBCJ01000001.1; note = Ulvibacterium marinum
ttaaagaatagtatgctttgcataccagattagtgagtcattaatctgtaaaagaactgaatttcaagctcatcaacttttcaaaaggcctccgagtacctccgaccttttgaaaagtttattccaaattgagc

SEQ ID NO: 16228 - RNA, 138 nt, unidentified
  source 1..138: mol_type = other RNA; note = Related to JAGIPR010000013.1; note = Chryseobacterium jejuense
taaaaaataattatgtatgtttaacataccggattagtgaatcattaatctgtaaatgaactgaatttcaagctcatcaacttttcaaaaggcctccgtgtacctccgaccttttgaaaagtttattccaatttgagc

SEQ ID NO: 16229 - RNA, 138 nt, unidentified
  source 1..138: mol_type = other RNA; note = Related to NZ_FSRQ01000001.1; note = Chryseobacterium scophthalmum
taataagaaaatagtatggtaacatactaggattagtgaagtcactaatctgaaaaagaactagttttcaagcttatcaagttttcaaaagatctccgttgacctccgaccttttgaaaactttattccaatttgagc

SEQ ID NO: 16230 - RNA, 137 nt, unidentified
  source 1..137: mol_type = other RNA; note = Related to NZ_QBKT01000004.1; note = Kordia periserrulae
aaaaaataaaaaaaaagctatttttgtattggatatgcgagtcgtaatatctgtatagggaatataatttcagagcagttccgaatcaaatactcctccagagtcgtcgcatttgattcggccttccaaaatattgg

SEQ ID NO: 16231 - RNA, 132 nt, unidentified
  source 1..132: mol_type = other RNA; note = Related to NZ_SNZW01000015.1; note = Maribacter caenipelagi
attaaaaaaagcttaaatttacgatggatgtacgagtcgtaccatctgtatagggaatttaatttcagagcagttccgaatcaaatactcctccagagtcgtcgcatttgattcggccttccaaaatactgg

SEQ ID NO: 16232 - RNA, 132 nt, unidentified
  source 1..132: mol_type = other RNA; note = Related to NZ_VFPD01000001.1; note = Chryseobacterium aquifrigidense
ttaaaaatattttgtaattttacaatgatgtctgaagtcggactatcataatagggaatataaatttcgagcagttccgattcaaaagctacgccagagtctccgcttttgaatcggccttacaaatagggg

SEQ ID NO: 16233 - RNA, 148 nt, unidentified
  source 1..148: mol_type = other RNA; note = Related to JABZUV010000100.1; note = Prevotella pallens
ataaaagatcaatttgtcccaaagggcaaacggttgtatgagtcatacagctgtattggtataagttttcaagcgtttcaggctgctaatgttattcaggcggtcagagcccgccttcacaacattagcgcctgatgtcagatgacaa

SEQ ID NO: 16234 - RNA, 156 nt, unidentified
  source 1..156: mol_type = other RNA; note = Related to NZ_HE999448.1; note = Prevotella sp.
ttaaaataacatatcaatttgtcctagggggcaagcggttgtatgagtcatactgctgtataggtataaggtttcaagcgattcaggcttctaatgttgtttcagcggtcagagcccgcttccacaacattagagcctgatgtcagaagacaaaga

SEQ ID NO: 16235 - RNA, 145 nt, unidentified
  source 1..145: mol_type = other RNA; note = Related to JADYUK010000009.1; note = Prevotella loescheii
atacaaaataaaataggtaactatttcggtggagcgagtcgctctttctgtactgagtatgtaatttcaagcttttgagccaatttgcttctcatgcgcccagaggtcgcattcccagcaaattgtctcaaatatcgaaaaatat

SEQ ID NO: 16236 - RNA, 127 nt, unidentified
  source 1..127: mol_type = other RNA; note = Related to JACOOE010000015.1; note = Bacteroides sp.
tatatagcttaataaagcattgggaatgaagagtcttcattctttatcaggaatacaatttctagccttgcgacttaaagaactcctccagagtcgtcgtcctttaagtcgctgatcgtaaaatata

SEQ ID NO: 16237 - RNA, 135 nt, unidentified
  source 1..135: mol_type = other RNA; note = Sphingobacteriales bacterium; note = Related to SEFL01000207.1
ctagactaatgccgtactaatgtactaggaatggtgagtcatcattccgaaaagcgaactggctttcaagcacttcgggggctccgcccttccgccaaaggctccagggctacgcccccgttcaacaaggaggga

SEQ ID NO: 16238 - RNA, 129 nt, unidentified
  source 1..129: mol_type = other RNA; note = Related to JACHWX010000002.1; note = Mucilaginibacter gotjawali
tgattaggatactggcgtaagcccgtgggaacggtgagtcactgttccaaaaagcgaactccttttcaagcttatctgtggaagtttgctccgctgagctacacaaacttccacagattccaatacagc

SEQ ID NO: 16239 - RNA, 142 nt, unidentified
  source 1..142: mol_type = other RNA; note = Related to NZ_WQOA01000003.1; note = Oscillibacter sp.
tgatagcctttacactttcgggtgttggtgcgaagatgtcttcgcgccatgaatgaactgattttccagccccgcaacgaaattgtgcataagcgcgacggagcggcttctccacaatttcgttgcagccaccgcaaatgga

SEQ ID NO: 16240 - RNA, 142 nt, unidentified
  source 1..142: mol_type = other RNA; note = Oscillospiraceae bacterium; note = Related to JAFQBT010000084.1
ttgatagctttaacacttttgggtgttggttcgatgatgtcatcgtgctagtaatgaacttattttcaagccctgcaatgaaatagctttcgaagtcacgggagtgacttctgcatctatttcattgcagtcatcacaaata

SEQ ID NO: 16241 - RNA, 142 nt, unidentified
  source 1..142: mol_type = other RNA; note = Related to NZ_BJEY01000003.1; note = Listeria newyorkensis
ctaatagtttttctgtgtttagagaagaacatatgcgtctgatttcagcgtgtataaagagaaccttgtttcaagctattcattaagaacatccaccacaagggattgtggagtctgttcttaatgaagtatatcgcaaaac

SEQ ID NO: 16242 - RNA, 145 nt, unidentified
  source 1..145: mol_type = other RNA; note = Related to JAARWV010000001.1; note = Listeria booriae
ctaatagtttttctgagtttagagaagaacatatgcgtctgatttcagcgtgtataaagagaaccctatttcaagctattcattaagaacatccaccacaagggattgtggagtctgttcctaatgaaagtatatcgcaagagca

SEQ ID NO: 16243 - RNA, 137 nt, Bacillus sp.
  source 1..137: mol_type = other RNA; note = Related to NUVJ01000020.1; note = Bacillus cereus
gtttgaggattttttgcaatgtgcagcgagtcgctgtgcaaatatggactgatttactagcccaagctttgaaagttataaacttgaaatgggaatttaaagtgttacaactttcaaaggagcgttctgaaaaacga

SEQ ID NO: 16244 - RNA, 126 nt, unidentified
  source 1..126: mol_type = other RNA; note = Related to CP065770.1; note = Enterococcus faecium
ctagtttaatactccatatggagcatggtttagtgagttcgctaagctaaaaagaactgatttacaagcttacagcttaaagaattttcccttcggagaagaaaaaaatcctttaagctgatggaa

SEQ ID NO: 16245 - RNA, 138 nt, unidentified
  source 1..138: mol_type = other RNA; note = Related to NZ_CP032418.1; note = Paenisporosarcina cavernae
ttagtattttgaccgaggtcagtatagcgattcgttatacactaatgaactgattttcaagcctgggacaaacgtaattcacggccgaagtcagagcttcgaacctttgaattacgtttgtcatagcataaattggga

SEQ ID NO: 16246 - RNA, 135 nt, Bacillus sp.
  source 1..135: mol_type = other RNA; note = Related to NUJF01000002.1; note = Bacillus thuringiensis
agttagtattttgaccgaggtcacgtacagcgattcgttgtgctctagtggattgattttcaagcctagggactaaagtaattcaatcatgaaaacggagtttcaaatcttgaattactttagtcggaaagctga

SEQ ID NO: 16247 - RNA, 119 nt, unidentified
  source 1..119: mol_type = other RNA; note = Related to PJWF01000007.1; note = Enterococcus faecalis
tagaaaacttgttttttatcctatttgtcgatttcgtcaagtagtaagagaatttgatttcaagctttgtaacaaataatttttctcaaggattcgaaaaacttatttgttacactagc

SEQ ID NO: 16248 - RNA, 125 nt, unidentified
  source 1..125: mol_type = other RNA; note = Related to NZ_JACCEL010000030.1; note = Ruoffia tabacinasalis
ctagcaatttgataaaacttagttttatcctatttgatgatttcgtcaagtagtaagaggaaagagtttcaagctctaggatagataattttattcaaggattcataaaattatctatcctagga

SEQ ID NO: 16249 - RNA, 139 nt, unidentified
  source 1..139: mol_type = other RNA; note = Related to FPKH01000001.1; note = Janthinobacterium lividum
ttgacatcagatctagtggcgcaagccactgaacggcgattcgccgttcttatgaaatgttagtttcaagccttatcatggacttgcctttccgccaggaggcgtcaagacaagtccatgatggccttcggccttaaac

SEQ ID NO: 16250 - RNA, 134 nt, Nitrosomonas sp.
  source 1..134: mol_type = other RNA; note = Related to JAHBZZ010000012.1
gcaccagacctttatagcgaaagctatggaatggcgattcgccattctgggaagaactgactttcaagccataccaagagaactaaattgtccacggagttgacaatttattctcttggtaagcctgatggctt

SEQ ID NO: 16251 - RNA, 129 nt, unidentified
  source 1..129: mol_type = other RNA; note = Related to NZ_JWZY01000031.1; note = Herbaspirillum rubrisubalbicans
ctagaccttagtagcgaaagctacggatcggcgattcgccgttctaggaagaacttactttcaagccattactgaaggttcgaccaatccgtcggagacggcttggccaaaccttcaggagccttcggc

SEQ ID NO: 16252 - RNA, 138 nt, unidentified
  source 1..138: mol_type = other RNA; note = Related to NZ_CP014167.1; note = Paenibacillus yonginensis
ttagactttatgtggtttatccacaggtttgacgagtcgtcaagctaagaagaaccttatttactagccttagtgacaataactttcccttccgccagagtctccagaaaaagttattatcacaactccggcttcgcc

SEQ ID NO: 16253 - RNA, 141 nt, unidentified
  source 1..141: mol_type = other RNA; note = Related to NZ_FNAZ01000007.1; note = Paenibacillus sp.
ttagaactttatgtggttttatgccacaggtttggcgagtcgtcaagctaagaagaacattatttacaagccttggtgatcataacttttccctccgacggagtctacagaaaaagttatgaccaccactccggctgatgc

SEQ ID NO: 16254 - RNA, 139 nt, unidentified
  source 1..139: mol_type = other RNA; note = Related to NZ_JADBEL010000024.1; note = Sporosarcina limicola
ttagacttaaagtggtttaaccacgcgtttggcgagtcgccaagcgaagaagaaccttacttacaagcctggtgttaatagcttcgtctgttcgcctggaggctctcatccaaagctattaacacactacggctggcgc

SEQ ID NO: 16255 - RNA, 141 nt, unidentified
  source 1..141: mol_type = other RNA; note = Related to NZ_VCBL01000006.1; note = Rummeliibacillus suwonensis
attagactttgtgtgatacttatatcacacgtttggcgagtcgccaagcgaagaagaacagtattttctagccttttgttaataacttctccatttcccggaggtcaattccaaagttattaacaacactccggctaacgc

SEQ ID NO: 16256 - RNA, 141 nt, Bacillus sp.
  source 1..141: mol_type = other RNA; note = Related to JAEACL010000003.1; note = Bacillus halotolerans
ttagacttgttgtgatatttataatcacacgtttggcgagtcgccaagcgaagaagaacagtattttcaagccttttgttaataacttttcatctcccagaggtcgaattacaaagttattaacaacactacggctagcgc

SEQ ID NO: 16257 - RNA, 137 nt, unidentified
  source 1..137: mol_type = other RNA; note = Related to NZ_LFXJ01000013.1; note = Lysinibacillus xylanilyticus
ttagacttatgtgaataacaatcacatgtttggcgtttcgccaagcaaagaagaactgtatttctagcctgtcattaatagcttttcaatttcccggaggtcaatttcaaagctattaatggcactccggctttgcc

SEQ ID NO: 16258 - RNA, 140 nt, Bacillus sp.
  source 1..140: mol_type = other RNA; note = Related to JAEKFM010000007.1
ctagacttatggtttttttttaaaaaaaccaggtatggtgagtcaccatactaagaagaacttaatttcaagccctgtgtaatacatttaacgcgtcgggagacgctatataaatgtattacacaaccttaggcttgcgc

SEQ ID NO: 16259 - RNA, 128 nt, Bacillus sp.
  source 1..128: mol_type = other RNA; note = Related to NZ_CP071813.1; note = Bacillus mycoides
ttagaccttaacaatagttaattgtggctttggcgagtcgccaaggtaggaagaacttattttcaagcccattctaaaaggtgttcatccagcaggagctgttcagagccaccttttagacaccagac

SEQ ID NO: 16260 - RNA, 143 nt, unidentified
  source 1..143: mol_type = other RNA; note = Related to LR134338.1; note = Brevibacillus brevis
gaaaaatattagacttacgttgagaacacgttgtctgacgagtcgtcaggcggagaaggacttaatttcaagccatctttacaagcactaagcttcaaaccggagcttttcgcttagtgcttgtaaagtccgctgcgcttcaa

SEQ ID NO: 16261 - RNA, 137 nt, unidentified
  source 1..137: mol_type = other RNA; note = Lachnospiraceae bacterium; note = Related to JAFQBM010000021.1
taattagcctcattcacgcaagtgatggttgatgagttcgtcaatcagagaagaacttacttttctagcctgtgtttaaactccttccttttcgcaggagcgaaaactcatgagtttaaacacctacacaaattttt

SEQ ID NO: 16262 - RNA, 134 nt, unidentified
  source 1..134: mol_type = other RNA; note = Related to NZ_LT969517.1; note = Eisenbergiella sp.
ttagactcattcacattagtggtgattgatgagttcgtcaatcagagaagaaccagtttttcaagcctttgtgtgaacttagtctttttcacaggagtgaaaaagactaagttcacacagcttcgcaaatgaat

SEQ ID NO: 16263 - RNA, 129 nt, unidentified
  source 1..129: mol_type = other RNA; note = Related to NZ_FOLQ01000021.1; note = Spirosoma endophyticum
ttagacttacgcgtgaaaacgcaggattgatgagtcatcaatctaagaagtaccttacatcgagccaaaacctaatcgtttatttggtagcagagctacctgcataaacgattaggttccgacgagaaa

SEQ ID NO: 16264 - RNA, 139 nt, unidentified
  source 1..139: mol_type = other RNA; note = Related to QRIC01000038.1; note = Dorea longicatena
aatctttagacttagcacttatgtgcgggattagcgagtcgttaatctttgaggaacttacttttcgagccggagtaatacttgtccatgattttacaggagtaaaatcctgaacaagtattacgggtcgtgattttgt

SEQ ID NO: 16265 - RNA, 136 nt, unidentified
  source 1..136: mol_type = other RNA; note = Related to FMEZ01000001.1; note = Ruminococcus sp.
tttagactttgcacgtatggtgcgggattagcgagtcgttaatctttgaagaacttacttttcgagccggagtaatacttgttcatgattttacaggagtaaaatccaaaacaagtattactggtcgtgattttgt

SEQ ID NO: 16266 - RNA, 140 nt, unidentified
  source 1..140: mol_type = other RNA; note = Proposed Jingyaoa shaoxingensis; note = Related to JACRSZ010000030.1
aaatctttagacttagcacatttgtgcgggattagcgagtcgttaatcttagaggaacttatttttcgagccatagtaagacttgttcgttcttttacaggagtaaaatcccaaacaagtcttacaggtcgtgattttgt

SEQ ID NO: 16267 - RNA, 138 nt, unidentified
  source 1..138: mol_type = other RNA; note = Related to RKBT01000103.1; note = Solobacterium sp.
tttagactttgcattttatatgcgggaatagcgagtcgttattctttggagaatggtttttactagccattctagaaaagatttaatttctcacaggagttctaaatttaaatcttttctagctgcttgtaaattgaa

SEQ ID NO: 16268 - RNA, 138 nt, unidentified
  source 1..138: mol_type = other RNA; note = Lachnospiraceae bacterium; note = Related to JAFYBR010000063.1
tttagacgatacacttagaaacaggtgtaagggatccgcgagtcgcggatctaagaggaacttgtcctctggtcgcctgaatccgccgcgctttacaggagtaaagcgccactgcttcaggcattgcgcgctttcata

SEQ ID NO: 16269 - RNA, 135 nt, unidentified
  source 1..135: mol_type = other RNA; note = Related to NZ_LT635539.1; note = Blautia sp.
ttagaactatgcacaatggtgcgggaatggcgagtcgtcattcttagaagaacttgcttttctagccatatgacagattactcgtcaatttatgggaataaattaccaagtaatctgtcacagtgcttcccaaac

SEQ ID NO: 16270 - RNA, 136 nt, unidentified
  source 1..136: mol_type = other RNA; note = Related to NZ_CP028101.1; note = Fusobacterium nucleatum
atagattaattattaatttatagggattgatgagtcatcaatctagggagaacagattttcaagcctgtggataagaactattcatatttctctagaaagagcaatattcatagttcttatctgcaagaattgcgt

SEQ ID NO: 16271 - RNA, 127 nt, unidentified
  source 1..127: mol_type = other RNA; note = Related to WWTL01000016.1; note = Clostridium sp.
ctagacttatgcacttggtgcggggttggcgagtcgtcaacttaagaagaacttattttcaagcctgtgtaagaacaagctggattttgcgggagcaaaatcaatcttgttcttacgtaatcgagaa

SEQ ID NO: 16272 - RNA, 133 nt, unidentified
  source 1..133: mol_type = other RNA; note = Related to NZ_LT635469.1; note = Blautia sp.
ctagacttatgcactttgtgcgaggttggcgagtctgccaacttaagaagaacttattaacaagcctgtgtaagaacaagttcgattttgcgggagcaaaatctatcttgttcttacaaactcgagaattcat

SEQ ID NO: 16273 - RNA, 134 nt, unidentified
  source 1..134: mol_type = other RNA; note = Related to QTVG01000007.1; note = Eubacterium sp.
ctagacttatgcactttgtgcagggttgtcgagtctgtcaacctaagaagaacttattttcaagcctgtgtaagagcaatctttattttgcaggagcaaaatcaagattgttcttacgtattcgagaattcgga

SEQ ID NO: 16274 - RNA, 135 nt, unidentified
  source 1..135: mol_type = other RNA; note = Related to VMKF01000001.1; note = Geobacter sp.
tctagaccatgtgactctgtcacgtgaatggcgagtcgccattctaggaagaactgcttttctagccccgtatcgtcagacacttcgtcaattggatattgccgcagtgtctgacgatactacttcgcttcgctt

SEQ ID NO: 16275 - RNA, 123 nt, unidentified
  source 1..123: mol_type = other RNA; note = Related to QZJW01000035.1; note = candidate division WS5 bacterium
ctagccctatggtgagagatcaccgggatggcgagtcgtcatcctaggaagaactggctttcgagcctttgtgaacccggactcgtgcgccggaggcacccgagcccgggttcacaataacta

SEQ ID NO: 16276 - RNA, 131 nt, unidentified
  source 1..131: mol_type = other RNA; note = Related to JAEINN010000002.1; note = Maridesulfovibrio ferrireducens
tcattagaactttgggattactcccaatagagtggcgagtcgccattcccgaacgaacatcctttcaagccttttatgatcgtagcagctgctccggaggagacagctactacaatcataacgctgcgggc

SEQ ID NO: 16277 - RNA, 129 nt, unidentified
  source 1..129: mol_type = other RNA; note = Related to NC_020304.1; note = Desulfocapsa sulfexigens
ctagccttagtggcttagccacggaatggcgagtcgccattctggggagaacttgctttcaagcccaggcgaagattcaccaactcttggaaagagttggcgaatcttcgccccgcttccgcaaaagcc

SEQ ID NO: 16278 - RNA, 134 nt, unidentified
  source 1..134: mol_type = other RNA; note = Related to NZ_CP040896.1; note = Hymenobacter sp.
ttagtatcaggtagcttttaaagctacagggttgatgagtctgtcaacctgatgagaacttacattcgagcaattaataatgaaataaagtcaaagggatttgtcttcatctcattattaattacggcatgaca

SEQ ID NO: 16279 - RNA, 105 nt, unidentified
  source 1..105: mol_type = other RNA; note = Related to SEFI01001149.1; note = Sphingobacteriaceae bacterium
gattagcgagtcgttaatctaagaagaaccgactttcaagcggcatcaccgacactcattaagcgtcggagatgcttaatgagtgtcggtgatgccgctccggct

SEQ ID NO: 16280 - RNA, 138 nt, unidentified
  source 1..138: mol_type = other RNA; note = Related to JAFVUY010000108.1; note = Bacilli bacterium
tacatcagaatgtatattattaaatataccgattggcgagtcgccaatcttttaggaactggctttcaagccctgcaacgagtttcttttctttactgggaagtaaagacccgaaactcgttacagctcgcagttgga

SEQ ID NO: 16281 - RNA, 133 nt, unidentified
  source 1..133: mol_type = other RNA; note = Oscillospiraceae bacterium; note = Related to SVPN01000006.1
acatcagaacgtattctatgaatacagattggcgagtcgtcaatcatttaagaactgcctttcaagccttgcgtctacttttatcttttggtggaaccaaaaggctaaaagtagacgcagcttcgcaacgtgt

SEQ ID NO: 16282 - RNA, 140 nt, unidentified
  source 1..140: mol_type = other RNA; note = Related to NZ_CP060696.1; note = Caproicibacterium amylolyticum
tgcatcagactgtattcgcaagaataccgattggcgagtcgtcaatcttttatgaactgtctttcaagccccgcatagattttttcatacttcacttggaagtgaagccaaaaaatctatgcggctacgcagcaagctgc

SEQ ID NO: 16283 - RNA, 140 nt, unidentified
  source 1..140: mol_type = other RNA; note = Related to NZ_FOAT01000022.1; note = Ruminococcus albus
gtaccagaattgtattcaatatgtgaatacggattggcgagtcgtcaatcatttaggaacatgctttcaagcctttcgacaaatgtcttcattttcctagaaggaaaatgaatcaatttgtcgaaagctgagcaaagctc

SEQ ID NO: 16284 - RNA, 132 nt, unidentified
  source 1..132: mol_type = other RNA; note = Related to NZ_BQKV01000037.1; note = Faecalibacterium gallinarum
ctagaactatattctgtaagaatataatgaatggcgagtcgtcattctttgaagaaccccttttcgagccctcagggattcaaagcaaaagacggagcttttcctttgaatccctgatgcttcgcaagagtt

SEQ ID NO: 16285 - RNA, 134 nt, unidentified
  source 1..134: mol_type = other RNA; note = Related to WKQN01000003.1; note = Faecalibacterium prausnitzii
ctagaactatattctgcacaagaatataatggatgacgagtcgtcaccctttggagaaccatttttctagccctcagggattcaaatcaaaagacggagctttttctttgaatccctgatgcttcgcaagagaa

SEQ ID NO: 16286 - RNA, 93 nt, unidentified
  source 1..93: mol_type = other RNA; note = Related to NZ_QGNY01000001.1; note = Pedobacter sp.
ttagctcaagtggcccgtgagggctacgggtaagcgattcgtttacctgaggggaactttctttctagcgatttatacgatgagaaaatagac

SEQ ID NO: 16287 - RNA, 116 nt, unidentified
  source 1..116: mol_type = other RNA; note = Related to NRSW01000001.1; note = Mucilaginibacter sp.
ttagctcaagcagcttcggttgcggattagcgagtcgttaatctgaggagaacattgtttcgagcgtttgatattgttgagtttcgcggagctcttaggtgtatagcgcctcgagc

SEQ ID NO: 16288 - RNA, 130 nt, unidentified
  source 1..130: mol_type = other RNA; note = Related to CDNR01000033.1; note = Paeniclostridium sordellii
ctagaaacaaatggttttgtaccattagcagtacgagtcgtactgcctttgagaactgaatttcaagctacttcacagaaggcactccttcgggactcagtagcgccttctgtgaatgccccaaaggggc

SEQ ID NO: 16289 - RNA, 135 nt, unidentified
  source 1..135: mol_type = other RNA; note = Related to SEFT01000010.1; note = Sphingobacteriales bacterium
ttagactcggtagctgcttagcagttacagataggtgattcacctatcggagaagaaccagctttcaagctactttaataaatatctgcgttcgcaggagctctcttgagtatttattgaaagctatatataagt

SEQ ID NO: 16290 - RNA, 130 nt, unidentified
  source 1..130: mol_type = other RNA; note = Related to QUJF01000028.1; note = Butyricicoccus sp.
tgttagcgtatcgtttataacgatagtaatgcgagttcgtgttacgagtaaattctagttttcaagccccagataaacagttattttgtcgaggacgtcaaaataactgtttatctgaaccacttttgac

SEQ ID NO: 16291 - RNA, 142 nt, unidentified
  source 1..142: mol_type = other RNA; note = Related to JAFVWM010000017.1; note = Alphaproteobacteria bacterium
attagtcttagcaacttttgttgcgctgtaacgagtcgttatggtagaatgaactttcttttcgagccttagatacgctcaactttgtttaaacacagaggtttaaccgaaagttaagcgtatctaactcgcaagctcgtgt

SEQ ID NO: 16292 - RNA, 138 nt, unidentified
  source 1..138: mol_type = other RNA; note = Related to JAFXYS010000380.1; note = Candidatus Saccharibacteria bacterium
gaagaactagcctagacagaaatgtcggaacagcgagtcgttgttcttgattggaatagggttttaaccctcacttcaatgtgcgctcgaatcatcgatgatgcttctcgtttacattgaagtcattaaggctctcac

SEQ ID NO: 16293 - RNA, 138 nt, unidentified
  source 1..138: mol_type = other RNA; note = Spirochaetaceae bacterium; note = Related to JAGBFB010000015.1
agagaactagccatttgcagtaatgcatagaattacgagtcgtaattcgagacgagaacacccttttagcgtaggtcaaaagccttcgtatgatttggaaaatcatctcagtcttttgacctacgtatagaaatctga

SEQ ID NO: 16294 - RNA, 133 nt, unidentified
  source 1..133: mol_type = other RNA; note = Related to NZ_VTYX01000020.1; note = Prevotella copri
ttagtttaatgcgagaaatgcatggaattgtgagtcacaattcttctgagtaattacatcaagattgccattacaataaattttgtatggcaggagccatacaaaatttattgtaatggctggagccaaaggc

SEQ ID NO: 16295 - RNA, 141 nt, unidentified
  source 1..141: mol_type = other RNA; note = Related to JAGZTO010000032.1; note = Prevotella sp.
ataaagatattagttaagtgcattgaagcatggaaaagtgagtcacttttctttagaatagttataatcaagcctgccactccataaaatttggagtgcaggagcacttcaaattttatggagtggccgaacccttcgggt

SEQ ID NO: 16296 - RNA, 133 nt, unidentified
  source 1..133: mol_type = other RNA; note = Related to SUXO01000014.1; note = Bacteroidales bacterium
ttagtttgtccacttcggtgtgaggattagcgattcgttaatctactgagaatcttctttcaagccaaagtaatgtttagtttttacttcttggaagaagtaaaaactaaacattacttcggtcgcaagacaa

SEQ ID NO: 16297 - RNA, 138 nt, unidentified
  source 1..138: mol_type = other RNA; note = Bacteroidales bacterium 45-6; note = Related to MKRS01000610.1
tttttagtttgtcacatgaaaatgtgaagattgacgagtcgtcaatcgactgagaatttcctttcaagcctggaagtaagatgcaaattttgctttctggagaaagcgaaatttgcatcttacttcgactgcgcaagc

SEQ ID NO: 16298 - RNA, 140 nt, unidentified
  source 1..140: mol_type = other RNA; note = Related to NZ_JAJJWI010000010.1; note = Pontibacter silvestris
acattagactcagatggcttcggccatcatgaaaggcgagtcgcctttctgagaggaaccggttttcaagccgtttagtaaataaatgtttgttttgcggagcagaaacaaatcatttatttacacgcgctgcggggttt

SEQ ID NO: 16299 - RNA, 132 nt, unidentified
  source 1..132: mol_type = other RNA; note = Related to JACIGQ010000001.1; note = Rhizobium leguminosarum
ttagaacccagcggtaagaccgcaggatcggcgagtcggcgatctggattggatggtactttaggcccattcaatggaaatgaatttttcacggaggaaaaatgtaatttccattgaagcgccttacggcgc

SEQ ID NO: 16300 - RNA, 135 nt, unidentified
  source 1..135: mol_type = other RNA; note = Related to JACYUZ010000001.1; note = Rhizobium sp.
ttagaaccaagcggtaaaaccgcaggattggcgagtcgtcaatctggagtggatggaactttaggcccattcaatggaaatgaatttttcacggagcgaaaaataagtaatttccattgaagcgcctaacggcgc

SEQ ID NO: 16301 - RNA, 133 nt, unidentified
  source 1..133: mol_type = other RNA; note = Related to NZ_LJIB01000039.1; note = Rhizobium sp.
ttagaccccagcggtaatgccgcaggattggcgagtcgccaatctggattggatggcacttcaggcccattcaatggaaatgaatttttcacggagcgaaaaatgtaatttccattgaagcgcctaaaggcgc

SEQ ID NO: 16302 - RNA, 133 nt, unidentified
  source 1..133: mol_type = other RNA; note = Related to NZ_LSVB01000004.1; note = Brucella anthropi
ttagaccctagcggccagaccgcaggatgagcgagtcgcgcatctggaacggaccttactttaggcccacccaacgaaaacgaatttttcacatagtgaaaaatatagttttcgttgtagcgcccaaagggcg

SEQ ID NO: 16303 - RNA, 132 nt, unidentified
  source 1..132: mol_type = other RNA; note = Related to JAAXMM010000032.1; note = Agrobacterium sp.
ttagaccctagcggcttgaccgcaggatgagcgagtcgctcatctggattggaccgtatttcaggcccactctatgaaaacgaattttccacggagtggaaaatgtcgttttcatagtcccgcccttcgggc

SEQ ID NO: 16304 - RNA, 132 nt, unidentified
  source 1..132: mol_type = other RNA; note = Related to NZ_VZDO01000003.1; note = Aureimonas leprariae
ttagaccctagcgactgacgtcgcaggatgagcgagtcgttcatctggcgtgaacatgactttaggcccttgattggaacgagttctccacggagtgtcaaacgtcattccaatcaaagcgcctaaaggcgc

SEQ ID NO: 16305 - RNA, 120 nt, unidentified
  source 1..120: mol_type = other RNA; note = Related to CP015231.1; note = Tritonibacter mobilis
tgagtagttttgatactgcaagccgggatggcgagtcgccatccattgaccggacgtacaacaagccattaccgtcacaattttctcgcggagctgcgaaaactgtgacggtaattcgga

SEQ ID NO: 16306 - RNA, 119 nt, unidentified
  source 1..119: mol_type = other RNA; note = Related to NZ_KI421513.1; note = Leisingera caerulea
tgagtagtttaacactgcaagccgggatggcgagtcgccatccattgaccggacgtacaacaagccattaccgtcacaattttctcgcggagctgcgaaaactgtgacggtaattcgga

SEQ ID NO: 16307 - RNA, 119 nt, unidentified
  source 1..119: mol_type = other RNA; note = Related to JADCGC010000017.1; note = Roseomonas sp.
gaaagattacgagctggggcggcgagtcgccgtccatggtcggactgagaacaagccactacctttgccagcctctcgcggagctgcgaggccgtcaaaggtgttgctgcgtccttcgt

SEQ ID NO: 16308 - RNA, 134 nt, unidentified
  source 1..134: mol_type = other RNA; note = Related to NZ_WWEN01000004.1; note = Thalassobius mangrovi
ttagtactgacggttgacgctagtcgactgtcggagtcgcgagtcgcgtctcttagatcggacctagtacgagccatcgccttcgcgatgcttcgcaggagcaaagaaccgcgaaggcgatgtcgtccttacgt

SEQ ID NO: 16309 - RNA, 133 nt, unidentified
  source 1..133: mol_type = other RNA; note = Related to JAEPMN010000068.1; note = Shimia sp.
ttagtgctgacggttgacctcggtcaatcgtcggggatgcgagtcgcttccctttgatcggacctagtacaagccatcgtcttcgcgatactttgcggagcaaagaagcgcgaagacgaactcgtccttacgt

SEQ ID NO: 16310 - RNA, 125 nt, unidentified
  source 1..125: mol_type = other RNA; note = Related to RZOF01000138.1; note = Mesorhizobium sp.
tgagtcaaaagctcatgcgtcggtgcgtcgagtcgacgtgcaagattgaacgtaacatcaagccgttggcacaccttcggctcacaggagctcacctctcggtgtgccaatgctccttcgtcgca

SEQ ID NO: 16311 - RNA, 137 nt, unidentified
  source 1..137: mol_type = other RNA; note = Related to NZ_CP090423.1; note = Stenotrophomonas maltophilia
ggcgagttagcacatgccgcaaggcaggatcggcgagtcgccgtatctggaaagaactgtcattcaagcctcaggccgaatccgtcgtcgcgagcaggagctcgcaacgccgccttcgacctgcgccatgaagccgg

SEQ ID NO: 16312 - RNA, 137 nt, unidentified
  source 1..137: mol_type = other RNA; note = Related to NZ_KL638873.1; note = Xanthomonas arboricola
ggggaattagcacatgccgaaaggcaagatcggcgagtcgccgcatctgggaagaactgtcaatcaagccttaggccgaatccgccgtcgcgagcaggagctcgcaacgtcgccttcgacctgcgccatgaaaccgg

SEQ ID NO: 16313 - RNA, 133 nt, unidentified
  source 1..133: mol_type = other RNA; note = Related to NZ_JVIE01000007.1; note = Stenotrophomonas maltophilia
ttcaagttagcacatgccgaaaggcaaggccggcgagtcgccgagcctgaagcgaactatcattcaagcctcaggccaaaagcgtcattgcgagcaggagctcgcaacgccgttttggcctgcgccatgaaac

SEQ ID NO: 16314 - RNA, 129 nt, unidentified
  source 1..129: mol_type = other RNA; note = Related to NZ_CP029551.1; note = Methylobacterium sp.
ggaagaccacgtgggcaaccacaggagcggcgagtcgccgttctggagtgaactggctttctagcagggtgccagactgattttgaccggaggtcaaaagtcagccaggcaccgctcggctaaagcctc

SEQ ID NO: 16315 - RNA, 133 nt, unidentified
  source 1..133: mol_type = other RNA; note = Related to NZ_CP039546.1; note = Methylorubrum populi
ggaagcccatgtgggtaaccacgtgaatggcgagtcgccattctggagtgaacatcctttcgagctgctgatgaaaaccaaatttcggctagaagccaaaatccggttctcatcagacgctcggcaaagccga

SEQ ID NO: 16316 - RNA, 133 nt, unidentified
  source 1..133: mol_type = other RNA; note = Planctomycetaceae bacterium; note = Related to JAGQPV010000303.1
gtagtcccatcggcttggccgaggggcgtcgagtcgacgccctggggaactctcccctttcaagcccagcacattgaccaagcacctgaccgggaggtcaggttggttggtcaatgtgctcgctcagcttcgc

SEQ ID NO: 16317 - RNA, 132 nt, unidentified
  source 1..132: mol_type = other RNA; note = Related to NRRE01000008.1; note = Rhodovibrio salinarum
ctagtcctatgtggtttgaccacacgagtggcgagtcgccactcgaggaagaacgctccttcgagccagcgagcgggcggggttccccaaaaggatttggcgaaccccgcccgctcgtgcgtcggcaaagca

SEQ ID NO: 16318 - RNA, 132 nt, unidentified
  source 1..132: mol_type = other RNA; note = Related to NZ_JACDIT010000005.1; note = Chthonobacter albigriseus
tacgacgctagcggctctgccgcacgggaagcgagtcgcttcccaagggtgaactgacgaaacgacctagtcatggaccaatttctgcgcaggagctcgaaatcagtccatgactagcgctttcagcgctgc

SEQ ID NO: 16319 - RNA, 135 nt, unidentified
  source 1..135: mol_type = other RNA; note = Related to NZ_AP022332.1; note = Methylosinus sp.
gtgctagcagctagcgactcgatcgctaggaatggcgagtcgccattcttgagagaaccggctttcaagccctggtccggcgccctcgaactgcgggagcacttcgacggcgccggaccatgctcccgttggtcg

SEQ ID NO: 16320 - RNA, 130 nt, unidentified
  source 1..130: mol_type = other RNA; note = Related to JALLPZ010000001.1; note = Thalassospira xiamenensis
ctagtactagtggccatagccacacgagcggtgagtcaccgttcttgaaagaactggctttcaagcctcgatctaagggagctttcaattgccggaggcaattgagaagctcccttagatagctccggaa

SEQ ID NO: 16321 - RNA, 123 nt, unidentified
  source 1..123: mol_type = other RNA; note = Related to CZAO01000003.1; note = Bacteroides uniformis
attagctaagtctgaggtccacaagttaccaaagatattacagccccttggctgtgagtgcaaaattaagaatcattttactaataattatgacagacaagtctgtcataattatcagcctat

SEQ ID NO: 16322 - RNA, 124 nt, unidentified
  source 1..124: mol_type = other RNA; note = Bacteroidales bacterium; note = Related to JAAVFK010000042.1
tatagcagtatctgtgaaaacagaggcctgtacccgtttggtgcagtctatattaagctactttacatgatttctgtgtcacacccttcgttgcactacaggcgcgacacagaattcgccgata

SEQ ID NO: 16323 - RNA, 125 nt, unidentified
  source 1..125: mol_type = other RNA; note = Related to JAFQIH010000031.1; note = Alistipes sp.
attagcactgtctgcgaaagcagaagcctgcgcccgtttggcgcagacgagttaaagcaactttacatgattattatgtcataccccttcgctacgctcgaagcatgacataatagtcgccgatt

SEQ ID NO: 16324 - RNA, 114 nt, unidentified
  source 1..114: mol_type = other RNA; note = Bacteroidaceae bacterium; note = Related to SUYB01000005.1
attagcagtatctgtacagacagaagcctgcgtccgtttgatgcaggaaagttaaagtcacattacatgatttctatgtcacaccccatgggcgcgacatagaagtcgccgaaa

SEQ ID NO: 16325 - RNA, 107 nt, Flavobacterium sp.
  source 1..107: mol_type = other RNA; note = Related to BJSX01000096.1; note = Flavobacterium psychrophilum
attagctatgtcatttattgactttttaatcccttttggattaagaataattaaagctaaattatactgattagtgtgcaacaaaagtcgcacactattcactccgt

SEQ ID NO: 16326 - RNA, 120 nt, unidentified
  source 1..120: mol_type = other RNA; note = Paludibacteraceae bacterium; note = Related to JAGPFU010000113.1
attagctttgtcaattaattttgacctctttgtcccgttcggattaagggttatttaagctacattatactgatttgtgcgtaccacctcgtgcctcgggtcacgcacaattcacttcgt

SEQ ID NO: 16327 - RNA, 120 nt, Flavobacterium sp.
  source 1..120: mol_type = other RNA; note = Related to NZ_CP016907.1; note = Flavobacterium anhuiense
attagctttgtcaataaaaattgacttctttgtcccgtttggattaaggactattaaagctacattatactgatttgtgcataacacctcgttcctcgggccacgcacaattcacttcgt

SEQ ID NO: 16328 - RNA, 131 nt, Flavobacterium sp.
  source 1..131: mol_type = other RNA; note = Related to JAEUTX010000024.1; note = Flavobacterium lindanitolerans
attagcttagtctttatttttttacataaagacttcttaagactgtttgtctataagaataaatcaagctacattatactgattcatgtgcaacgcctgcgggcactcgggttgcacatgattcacttcgt

SEQ ID NO: 16329 - RNA, 128 nt, unidentified
  source 1..128: mol_type = other RNA; note = Related to AP023049.1; note = Alistipes indistinctus
attagctgtgtcttctagaagacatcttgagctcgtttggctcaagagtaattaaagctacattatactgattaatgtgtaatacctgcgttcgcaagctcacttgtatcacacattattcactcaga

SEQ ID NO: 16330 - RNA, 128 nt, unidentified
  source 1..128: mol_type = other RNA; note = Related to NZ_FNBN01000017.1; note = Chitinophaga filiformis
tttagcctttctctcgcaagagaaatcaaagccttgttttgatatgtctaaagctactttatactaaataatgtacaacaatcgccttcttgcgtcgcggggcgttgctgtacatcattcactaacgt

SEQ ID NO: 16331 - RNA, 128 nt, unidentified
  source 1..128: mol_type = other RNA; note = Related to PPEG02000004.1; note = Chryseobacterium viscerum
tttagttgtttctctgtggtaagagaagatttgcttcttgagcaaagtaataaataaagctactttatattatcttgatgaaaaacctttccacttctttcctttcctgtttttcatcaacacaacat

SEQ ID NO: 16332 - RNA, 126 nt, unidentified
  source 1..126: mol_type = other RNA; note = Related to JAAALB010000001.1; note = Cellulophaga sp.
attagctgttctcctagtgagataacttgttctttgaacaaggcaattctaaagctactttacattaactggtgtgtaacatatccaacgcacgggcaaccctgctgttacacaccaatcactaat

SEQ ID NO: 16333 - RNA, 143 nt, unidentified
  source 1..143: mol_type = other RNA; note = Related to JALKBC010000033.1; note = Arenibacter sp.
gcaagcaatttcaggtttaggttcttttctaaaggagattagacttgaatgggcaggcagtagtctgttcagggttgaagttacttttcaacacatccagtacaacatatcccttcgggagagttgtgctggatatgctacgc

SEQ ID NO: 16334 - RNA, 145 nt, unidentified
  source 1..145: mol_type = other RNA; note = Related to NZ_LXTT01000008.1; note = Muricauda sp.
gcaagcaatttcaggcataactacatttttttaaatgagatagggcctggaggctcgggcagtagtccgtgcagggttgaagttacttttcaacacttccagtacaacatatcccttcgggagagttgtgctggaaatgctccgc

SEQ ID NO: 16335 - RNA, 146 nt, unidentified
  source 1..146: mol_type = other RNA; note = Related to NZ_FNQK01000016.1; note = Bizionia paragorgiae
gcaagctatttcgagtcagtttgtgttcgtgagaacatttgaaggacaagaactcatagacagtagtttatgtaggactgaagcatcttttcaacttttactacacaaaaccttcctacgtcaggttcgtgtagtaaatgcttcgc

SEQ ID NO: 16336 - RNA, 134 nt, unidentified
  source 1..134: mol_type = other RNA; note = Related to NZ_WNKF01000001.1; note = Cyclobacterium roseum
gcaagccgtttcgagtcaatttgtatttaaaggacgagaatgcttgggtagtaatccgagtaggactgaagcatcttttcaacattttcagcacaacgcctcactgcgttcgggtcgtgctgaagatgcttcgc

SEQ ID NO: 16337 - RNA, 146 nt, unidentified
  source 1..146: mol_type = other RNA; note = Related to MENU01000192.1; note = Bacteroidetes bacterium GWE2_29_8
gcaagcaatttcgagtcaatttgtgtttgaaaaaacatttaaagggcaagaatacctgggtagttatccaagtatggctgaagcaacttttcaacatttactacacaagatcctccttcgtcagactcgtgtagtatatgcttcgc

SEQ ID NO: 16338 - RNA, 138 nt, Flavobacterium sp.
  source 1..138: mol_type = other RNA; note = Related to NZ_CP030261.1; note = Flavobacterium fluviale
gcaagcaatttcaagtcatttaaataagtttaaatcttgatttcctggatagttatccaagaatttagtgaagtaacttttcaaactttactgcacaatatcctcactacgttccggtttgtgcagtaatgctcacgc

SEQ ID NO: 16339 - RNA, 149 nt, Flavobacterium sp.
  source 1..149: mol_type = other RNA; note = Related to NZ_JADHEC010000003.1; note = Flavobacterium soyangense
gcaagcaatttcaagtcaatgtagttttttaactacatttaaagggcaagaatacccgggtagttatccaagtagggctgaagcatcttttcatcatttcccacacaacatcctcctaaaaagtcggacctgtgtgggatatgcttcgc

SEQ ID NO: 16340 - RNA, 142 nt, unidentified
  source 1..142: mol_type = other RNA; note = Related to NZ_CP074436.1; note = Polaribacter sp.
gcaagcaatatcttgtcttaatacaaattgtaataagaaaggtgacttgaacagttgttcacgtttagctgaagttacttatcaactttcataccacaacatctctgcaagtattcaagagttgtggcataatacgcttcgc

SEQ ID NO: 16341 - RNA, 142 nt, unidentified
  source 1..142: mol_type = other RNA; note = Related to NZ_LR824569.1; note = Chryseobacterium sp.
gcaagcaatttcttgtttaaacgctacggaatataagcaggattacctgaacagttgttcaagtttagctgaagatacttatcaactttctcaccacaacatcattccaagtattcatgagttatggtgggatacgcttcgc

SEQ ID NO: 16342 - RNA, 142 nt, unidentified
  source 1..142: mol_type = other RNA; note = Related to PASE01000008.1; note = Muricauda sp.
gcaagcagtatcttgtttaatatcaagtattagtaaacaggatcccttgagcagttgttcaagcttagctgaagcatcttatcaactttcactacacaacatctctgcagggattcaagacttgtgtagtaaatgctggcgc

SEQ ID NO: 16343 - RNA, 179 nt, unidentified
  source 1..179: mol_type = other RNA; note = Related to NZ_FSRA01000001.1; note = Chitinophaga niabensis
acaagcattatcttgtttaattgtgtcgaaagacattaaatatttcgcagaaatgcataaatatttgtacaaaggcaagataacatgagcagttgcacatgtatggctgaagtaacttttcaacctttaatgcacaacatgtctccaagtattcaaaagttgtgcattaaacgcttcgc

SEQ ID NO: 16344 - RNA, 185 nt, unidentified
  source 1..185: mol_type = other RNA; note = Related to JACCBZ010000002.1; note = Mucilaginibacter sp.
gcaagctatatcttgtttaattacgcaaatagcgtttattttcgagttggccagcaatgtccaatcttgatgttacgaaagcaagataacctgaacagttgttcaagtgtggctgaagcaacttttcaacttttaacacacaacatgtctgcaagtgttcgccacttgtgtgttaaatgcttcgc

SEQ ID NO: 16345 - RNA, 167 nt, unidentified
  source 1..167: mol_type = other RNA; note = Related to VFPL01000001.1; note = Arcticibacter tournemirensis
gcaagcaacatccggcctaacttggcacttactgcctttgttttctgaaaggaaaatgcaaaggtcggatatcccatcagtagatggggaaatggttgaagatacttttcaacccttgatacacaacatcactgcaggtattcgcgagttgtgtaccaaagcttcgc

SEQ ID NO: 16346 - RNA, 121 nt, Bacillus sp.
  source 1..121: mol_type = other RNA; note = Related to CP095875.1
actagattcactacattgggagtgtagagactaaggcatttgtcttagtggcataaagcaactttataacaagcctgcaccaccacttgcttcactgcgggttgcacaggctgtttcaagc

SEQ ID NO: 16347 - RNA, 132 nt, unidentified
  source 1..132: mol_type = other RNA; note = Related to VFNO01000006.1; note = Brevibacillus sp.
gttagccgtggcctttgttatggcgactaagttgagtcaacttagtaattgtaaagcaactttcattgcgtcttctctacaaccattgacagaaagtatctcgaagaagtaggttgcagagaaggcgcacac

SEQ ID NO: 16348 - RNA, 140 nt, unidentified
  source 1..140: mol_type = other RNA; note = Related to NQMO01000005.1; note = Paenibacillus sp.
gctagcatcggcctaataaaccaggcgactaggttgagtatacctagtaaggataatgtttctattatagcaacttctctacaaccacgagatacaggaagtaattcggagaagatggttgcagagaaggtgcacaccgc

SEQ ID NO: 16349 - RNA, 143 nt, Bacillus sp.
  source 1..143: mol_type = other RNA; note = Related to CP026036.1; note = Bacillus subtilis
gttagcaatgccacaattaacgggtaccgccgcagttgtgggaccaagactggttaggcttggttgtgatgaagtgacttttaaacgactaattgcataacactacccaaaggcggggtaggctatgcaatccctcgctctgc

SEQ ID NO: 16350 - RNA, 140 nt, Bacillus sp.
  source 1..140: mol_type = other RNA; note = Related to CP043830.1
gttagagtttttcacgatcaaacggttttatctgttagagagtgaggccaagactatttggcttggctactgataaagttactttataacgacctggtacataacactccccttggtcggttatgcactatctcgctcgc

SEQ ID NO: 16351 - RNA, 109 nt, unidentified
  source 1..109: mol_type = other RNA; note = Related to NZ_VATY01000001.1; note = Maribacter algarum
gttagcaattaaccctaataaggttttctcagtgtagttcattgagaattattgaagccacttgatagcataacttatatgttattaataatatgcttaaagactaaac

SEQ ID NO: 16352 - RNA, 109 nt, unidentified
  source 1..109: mol_type = other RNA; note = Related to NZ_CP058986.1; note = Polaribacter sp.
gttagcaaataaccctagtacggttttctcagtgtagttcattgagaattagtaaagctacttgataatataatctatatgttatcaataatatgattaaagactaaac

SEQ ID NO: 16353 - RNA, 94 nt, Flavobacterium sp.
  source 1..94: mol_type = other RNA; note = Related to NZ_MUGY01000012.1; note = Flavobacterium hydatis
gttagcaaataacccgtaataaggttttctcggtgtagttcatcgagaactaataaagctacttaatagcagactcagcaatacttttgctcac

SEQ ID NO: 16354 - RNA, 86 nt, unidentified
  source 1..86: mol_type = other RNA; note = Flavobacteriaceae bacterium; note = Related to DTTW01000005.1
gttagctaaatctctcataagagggattctcaggatagtttcttgagaagtactaaagctacttaacagaaatttatttgctatgt

SEQ ID NO: 16355 - RNA, 128 nt, unidentified
  source 1..128: mol_type = other RNA; note = Related to BMFQ01000008.1; note = Bizionia arctica
tttagctttaatttttactagtagtaatagtagtaaaaagctaggactagttgtctatagttgtattaatgttagcttatatcgtttaagtagtgaaacgctaaaggttccactactcaaagcaaagc

SEQ ID NO: 16356 - RNA, 121 nt, unidentified
  source 1..121: mol_type = other RNA; note = Related to SJXJ01000003.1; note = Tenacibaculum sp.
tttagctgtatttttactagaaatggtaaaaagctaggactagttgtctatagttgtattaatgttagcttatatcgtttaaatagtgcaacgctaaaggttacactattcaaagcagagc

SEQ ID NO: 16357 - RNA, 119 nt, Flavobacterium sp.
  source 1..119: mol_type = other RNA; note = Related to MUFX01000009.1
tttagctatttttttactttatgtaaaagctgtagactagttgtctatagatgtttttaatgttagcttatatcgtttaaatagtgaaacactaaaggttccactactcaaagcagagc

SEQ ID NO: 16358 - RNA, 132 nt, unidentified
  source 1..132: mol_type = other RNA; note = Related to QSQY01000003.1; note = Parabacteroides sp.
tttagcttatacttttacttcttgtaaaaggctggaactagttgtctccggcagtaataatgttagtttacatcgtttaagtagtgaaactcggtctcgcaagctcgcaggcttcactactcaaagcatagc

SEQ ID NO: 16359 - RNA, 120 nt, unidentified
  source 1..120: mol_type = other RNA; note = Bacteroidia bacterium; note = Related to JAEUTP010000018.1
attagcaattgtttcaattttattgagacaccatgcacagtgggcatggttgctgtaaagctactctacatcattttgatgtacaacacccttcggggctgtacatcagaacgcgcgcgt

SEQ ID NO: 16360 - RNA, 125 nt, unidentified
  source 1..125: mol_type = other RNA; note = Related to NZ_LBIQ01000028.1; note = Mangrovimonas sp.
attagccattatcaattttttgaaattgattctgttctgtatacgaatggaggctctaaagtaactttacatcatcttgtatgcaagtcggtacagttgtcagcttgcatacaacaacgcgcagc

SEQ ID NO: 16361 - RNA, 118 nt, unidentified
  source 1..118: mol_type = other RNA; note = Related to SUYI01000044.1; note = Prevotella sp.
tctagctttgagtgaagatgaaatattctttgccggtatgtctcgtggacatactgaaattaaaacaccattatactgataatgctgaacaaggattgtccagcattgtcactaacgt

SEQ ID NO: 16362 - RNA, 118 nt, unidentified
  source 1..118: mol_type = other RNA; note = Related to JAGCCF010000043.1; note = Paludibacteraceae bacterium
tctagctttatgtgaagatgaaacattctttgccggtatgtctcgtgggcatactgaaattaaaacaccattatactgataatgctgaacaaggattgtccagcattgtcactgacgt

SEQ ID NO: 16363 - RNA, 117 nt, unidentified
  source 1..117: mol_type = other RNA; note = Related to NZ_RBXN01000012.1; note = Coprobacter fastidiosus
tttagctttaagtaaagatgtaatactctttgcctgtatgtcccgggggcgtacagaaattaaaacacaattacactgatagtgctgaacaaggcttgtccagcactgtcactaaag

SEQ ID NO: 16364 - RNA, 123 nt, unidentified
  source 1..123: mol_type = other RNA; note = Bacteroidia bacterium 43-41; note = Related to MKTD01000020.1
attagctatcagtatagaaatatacgggttggtcttttggacttacttttattaaaacaactttatactgaataactgaaacgcgcctccgcaggctacagcggttccagttgttcacttcgt

SEQ ID NO: 16365 - RNA, 111 nt, unidentified
  source 1..111: mol_type = other RNA; note = Related to VZAS01000054.1; note = Prevotella copri
attagctgaatatgggattagcatattcgtatgtcttttggacatgctagattttaaatgtcattatactaagtatatcgaacaataaatgttcgatatgctcacttgcgt

SEQ ID NO: 16366 - RNA, 139 nt, unidentified
  source 1..139: mol_type = other RNA; note = Related to JAGBLT010001022.1; note = Bacteroidaceae bacterium
attagcttatggttatccgttgtttcataacaaagatgacaggtcggttcccttggagcccactgaacagtaaaacacctttatactgtaacgatgaaatacgcttcgctttgctcgcgattccatcgctacactctgc

SEQ ID NO: 16367 - RNA, 170 nt, Bacillus sp.
  source 1..170: mol_type = other RNA; note = Related to NPDG01000102.1
aatagtctctagaaaggtagagagtctctatcagatttaatgttacttaattgattggatgaaaagaagaaaaccacttcttttcacccatgcaaattatcatttgcatgagcctaatgattaaataaaaagcaatttaatcataggcttaattttcataagtgattatt

SEQ ID NO: 16368 - RNA, 201 nt, unidentified
  source 1..201: mol_type = other RNA; note = Related to JALMMK010000003.1; note = Clostridioides difficile
aataatctctagcaactaatagcgagtcgctatttaatatagaatgtttcttgatagatacagtactaaagcaagcgagttgtttagtactgtgttgaattaaataaaaagcgatttaattcaacacatttagtgaaccaaataaaaaacgatttaattcactaaatgtattttcaaaatacatgatttagctagtatatt

SEQ ID NO: 16369 - RNA, 152 nt, unidentified
  source 1..152: mol_type = other RNA; note = Related to NZ_NOJY02000076.1; note = Romboutsia sp.
aataatctctagcaattaatagcgagtcgctatttaagatgaaatgtttctttatagatacaggactaatataagatcgttattagtcctgcgttgaattaaataaaaagcaatttaattcaacagttttatcggattaaataaaaaccaat

SEQ ID NO: 16370 - RNA, 216 nt, unidentified
  source 1..216: mol_type = other RNA; note = Related to NZ_CP017603.1; note = Clostridium formicaceticum
aaagccctctagaatttgaacagcgaatcgctgttcgttatttaaagtttctaaatatctcatggaactaaaatcttcttgagagtaaggtttcgagggtcgaattttagttccatgtatattgcggaaaatcatcgcaatatacagcctaaaaaggtttaaactgcaaaacctttttaggctgagtttgcaattatagttttcgtagagggcttt

SEQ ID NO: 16371 - RNA, 185 nt, unidentified
  source 1..185: mol_type = other RNA; note = Peptostreptococcaceae bacterium oral taxon 081; note = Related to JABXYS010000002.1
tgcatggaatagaaatcgaatgacaagttgtcattcttaataaaaatgtatctttgtatcataggatgattatttaaagaaataatcatcctatgaaaccattggaattacaatggtttcgtctatctttattgcaagcaataaagatagagtatgtttcaataacagaattagtatttcatgca

SEQ ID NO: 16372 - RNA, 173 nt, unidentified
  source 1..173: mol_type = other RNA; note = Related to NZ_JAHLDH010000001.1; note = Clostridium algidicarnis
atgtattaatagaaagcgaagaacaagttgttcttcatagttacaatatttctttgttttatagtagattaaagtcaaagactttaatctactgtaaacagttgcaactgcaactgtttacatcaacaccaaggtgttgatatattttaataacagaataggtattggtacat

SEQ ID NO: 16373 - RNA, 174 nt, unidentified
  source 1..174: mol_type = other RNA; note = Clostridia bacterium; note = Related to JAFUNX010000099.1
tatagtcattagaatatgaggagcaagttgcttctcgaaaacaaaacgtttcttctttgtcacatgtgaattcgaagaattcacatgcgcaaaagacggaatagcctatttgcacatgtgatgcttattctaagcatcacatgcaagaatgaatcagacagagtagtgactata

SEQ ID NO: 16374 - RNA, 182 nt, unidentified
  source 1..182: mol_type = other RNA; note = Related to CP042469.1; note = Clostridiales bacterium
tgtatcgattagaaagcgagaaacaagttgtttctcatagttaaaatgtcacttactgaatgaggataaaatcaaagattttatcctcgtccacaaaattaaaatcttgtggacgagcatatctgttggaaaatctcaacagatatgctcactagtacaaataaagaaacggtagtcgtgca

SEQ ID NO: 16375 - RNA, 183 nt, unidentified
  source 1..183: mol_type = other RNA; note = Related to NZ_CP065321.1; note = Acutalibacter muris
tgtgtctgttagaatgcgagaagcgagtcgcttctctaagtgccaacggtgcttactttatcaatgtgtatgttcccagtaacatacacattgcaaagcgcttggaataaagcgctttgcaatggtattgcggtatgccgcaataccactgcttgttcagaaacagaatgggtaataggtacg

SEQ ID NO: 16376 - RNA, 202 nt, unidentified
  source 1..202: mol_type = other RNA; note = Related to JABMAY010000023.1; note = Dialister sp.
tgtacgcattagaatgcggaacgcgagtcgtgttccaaagtagcaatggttcttatttcatcatgacaacaattcgcccggaattgttgtcatggcaaattgcttggaataaagcaatttgtcatgtcatacacgacaatttggagcggtccaaattgtcgtgatgccatgatttccaaattcagtacaggtaatgcgtaca

SEQ ID NO: 16377 - RNA, 174 nt, unidentified
  source 1..174: mol_type = other RNA; note = Related to JAHRFW010000235.1; note = Erysipelothrix sp.
cacacctattagaaggcgaaagatcagtggtctttcatagctagaatgtcacttattacgattgtcaattatcgaagattaattgacaatagcattctgattaacagaatgcagtaatgtttggaaatactcaaacattacttgattataaaaatagatttggtagtaggtgtg

SEQ ID NO: 16378 - RNA, 206 nt, unidentified
  source 1..206: mol_type = other RNA; note = Related to PGZS01000061.1; note = Firmicutes bacterium HGW-Firmicutes-3
cgcatccgttagatggcgaaaggacagtggactttcataggatgtaggtttcttaatgtgcagataaagaaagccaagctttctttatctgtatatgttggcataacaacatatacagaatatattggttctcctcgcggaagcggttccgctcgtcaaaccaatatatactgcttaagcaaataaagattttggtagcggatgcg

SEQ ID NO: 16379 - RNA, 189 nt, unidentified
  source 1..189: mol_type = other RNA; note = Proposed Lachnoclostridium pacaense; note = Related to JAJFDX010000002.1
tgcatctgttagaaagcgaaaggacagtggcctttcatagttgcaaggtttcttaatatgcagattaagtagcaaagcatacttaatctgaatatgttggcattacaacgatattcagcaaatgttgttgcatgcgaatgcaacaacatttactgctttagcacaaatacagaaatagtagcaggtgca

SEQ ID NO: 16380 - RNA, 179 nt, unidentified
  source 1..179: mol_type = other RNA; note = Lachnospiraceae bacterium OF09-6; note = Related to QUMM01000064.1
tgcatctgctagaaatcgaaaggacagtggactttcataggaataaagctgcttaatatattaggatgaaacatgtacaacatgtttatcctaatatgttggcattgcaacatatattcgctacaatctataatgattgtagcgacggattttcaaatacagaatgggtaacaggtgca

SEQ ID NO: 16381 - RNA, 205 nt, unidentified
  source 1..205: mol_type = other RNA; note = Related to QVIB01000063.1; note = Dorea longicatena
tatattggctagaaatagaaaatcaagttgattttcataattgtaaagtgtcttacatttattatcagtaaaagactaacgttcttttactgatagtaaagtgatttcgcaacgggggttgctcaatcactttactatctttataattcattgcttgacaatgatttataaagataattttcagttaggttaggtagcttgtata

SEQ ID NO: 16382 - RNA, 207 nt, unidentified
  source 1..207: mol_type = other RNA; note = Related to JAGZKG010000016.1; note = Roseburia hominis
tatatttgttagaaaaagaaaatcaagttgattttcaaagcgaaaatgtttcatacgtttattatcaggaaaagggtaatgctcttttcctgatagtaacgttatgctcgcaggagcaactgctctcataacgttactatcattacaactgattggttgacaatcagttgtaatgagaattttcaattagatggggtagcaaatata

SEQ ID NO: 16383 - RNA, 157 nt, unidentified
  source 1..157: mol_type = other RNA; note = Related to NZ_CAKODJ010000004.1; note = Adlercreutzia muris
gccagtgtctagaaggcgggaggcaagttgtctctcatagtggcaatgcgcttttcagagaccaggcttttgagcagagcccaaaagcctgcgcgcgaagtggcgcgccagaagcgaagcttcaggtctttcaaaaacagataaggtagacactggc

SEQ ID NO: 16384 - RNA, 257 nt, unidentified
  source 1..257: mol_type = other RNA; note = Clostridia bacterium; note = Related to JAFXDF010000036.1
agcagtgtctagaaaatgagcgactagttgttgctctatgattcaacggcacttgaagccatatgtgtgtggcggcagtgggcggcctaaaggctcgcgaccacttgcctagccgcacacatatcatatggcttcgccagacgataccaataatgacatacgattatcgagataatcgtatgtcaggcgtaccgcctgctatataccgtgctggcgcacggtatatagcataactatcagtttaggtagatgctgct

SEQ ID NO: 16385 - RNA, 257 nt, unidentified
  source 1..257: mol_type = other RNA; note = Clostridia bacterium; note = Related to JAFVRR010000006.1
atcaacacctagaaatcgaaaaacgagtagtttttcttattaacaaaggtactttgttcacaaacgcaagcgtttgttatgttatttcctcaaggaatacattcctatcgtaaataacatatcaaatagtggcggtgggcacaaattttgcgttggtaaaccaatcgcaaaatatttgtgcttccacgcttgctcaccatttgaagttatggcattgccaaaccaatataaaatttaaagataaagtaggtgttgat

SEQ ID NO: 16386 - RNA, 183 nt, unidentified
  source 1..183: mol_type = other RNA; note = Related to NZ_CP075175.1; note = Paenibacillus sp.
gagatcttctagattagaataacgagtcgttattcgatgatagtaaggggactttttgctcggggaagaaaatctccgccgctccgcttgctacaatcttctcccccgaacaataagaaaagcacttattgttctttctaattaaagtgtgtgtgctaggccataaaatgggtagaaggtctc

SEQ ID NO: 16387 - RNA, 202 nt, unidentified
  source 1..202: mol_type = other RNA; note = Related to NZ_CAJGBF010000001.1; note = Rossellomorea arthrocnemi
tatgttttctagaattgaatagcgagtcgctattcgtgatgtaaagttactatgtagctgtatcagtactaattttgaagagcgaaaattagtactgaaccaacaaagaagagcgctttgtcggttcaccataacaaaatccctgaggtcaaggatttcgtgatggtgatcagttaaattaaataatccagtagaaaacata

SEQ ID NO: 16388 - RNA, 202 nt, unidentified
  source 1..202: mol_type = other RNA; note = Related to NZ_VTEU01000001.1; note = Sutcliffiella horikoshii
tatgttttctagaattgaatagcgagtcgctattcgtgatgtaaagttactatgtagctgtatcagtcctaattttgaagtgcgaaaatttggactgaaccaacaaagaagaccgctttgtcggttcaccataacaaaatccctgaggtcaaggattttgttatggtgatcagttaaattaaataatccagtagaaaacata

SEQ ID NO: 16389 - RNA, 196 nt, unidentified
  source 1..196: mol_type = other RNA; note = Related to NZ_JACSLM010000003.1; note = Exiguobacterium sp.
tatgttttctagaattgaacagcgagtcgctgttcgtgaattaacgttacttagtagctgtcactgcacaatttttcctgaaaaattgtgctgtaacaacaaagaagttcactttgttgttcatcaccgtgaattatcgaggtcgagaattcacggtgatggatcagttaattaaacaaatctagtagaaaacatg

SEQ ID NO: 16390 - RNA, 203 nt, unidentified
  source 1..203: mol_type = other RNA; note = Related to JADCLJ010000021.1; note = Cytobacillus luteolus
agtgtcttctagaattgaatagcgagtcgctattcgtgaagttaagttactatgtagctgtctcagtactaattttgaaaagcgtaaaattagtactgaaacaacaaagaagagcgctttgttgtttcaccataataaaatcttagaggtcaaagattttattatggtgatcagttaaattaaataatccagtagaagatatt

SEQ ID NO: 16391 - RNA, 200 nt, unidentified
  source 1..200: mol_type = other RNA; note = Related to VENA01000064.1; note = Firmicutes bacterium
catgttttctagaattggatagcgagtcgctattcgtgaagtaaagttactatgttgctttttcagtactaattttagaagcgtaaattagtactgaaacaaccaacagaagcatttggttgttcacctaaataaaatattagaggtcaaagattttatttaggtgatcagttaagtaaagaaatctagtagaaaacaat

SEQ ID NO: 16392 - RNA, 175 nt, unidentified
  source 1..175: mol_type = other RNA; note = Related to LFJO01000006.1; note = Alkalihalobacillus pseudalcaliphilus
gttgttttctagaattgagcagcgagtcgctgttcgtgaagtaaagttactatgtatctatgatactaattttcaagagcgtaaaattagtatcatacaacaaagaaaatcactttgttgtatacaccagtaaacgtggtgtataggtaaattaaataatccagtagaaaataac

SEQ ID NO: 16393 - RNA, 177 nt, unidentified
  source 1..177: mol_type = other RNA; note = Related to SMZU01000020.1; note = Rhodococcus qingshengii
tgtattttctagaattgagtaacgagtcgttactcgtgaagcaaggttactttgtggcaaatgaccttgtttagaagagcactaaacaaggtcatcccccaaagaagatcgttttgggggatgaggaaaaagaaaccttcctcagtagttaattggaaagaaccagtagaaaatatt

SEQ ID NO: 16394 - RNA, 178 nt, unidentified
  source 1..178: mol_type = other RNA; note = Related to NZ_CP045040.1; note = Carnobacterium maltaromaticum
aaaatttgttagagtgtctgaaaagcgagtcgcttttctaagaacttaagttcctaaatagcaaaacatgcttgaacaaagtgcgtccaagcatgcttcgctaaagctccgacagtaatttgattatttccgaaggtctcaataataaattactgttttgaaaaatttaagaaatatt

SEQ ID NO: 16395 - RNA, 178 nt, unidentified
  source 1..178: mol_type = other RNA; note = Related to KQ130593.1; note = Listeria newyorkensis
taactttgttagagtgtctgaggagcgagtcgctcctctaagaattaaaatttctaagtagcaaaacaagcttgcgccaaggcccaagcttgctcgctctgctccgcagtagttagattatttccgaaggtctcaataactaaactactgttttgaaaaattaatgaactattagtta

SEQ ID NO: 16396 - RNA, 179 nt, Bacillus sp.
  source 1..179: mol_type = other RNA; note = Related to NZ_CP084677.1; note = Bacillus safensis
tgtaagaaaggcgagtcgcctttcgaataagcaacgttacaaaattctgaattagcaaacaaatcgagatttgtttgctaatttgaaacggaaagcgcgtttcaaattacctaacttataagttgaggttcaaacttctcaagttaggtaattaaataatgaaagattcaatgggttca

SEQ ID NO: 16397 - RNA, 167 nt, unidentified
  source 1..167: mol_type = other RNA; note = Related to JABBEA010000018.1; note = Paenibacillus sp.
agctgtgactagacttttagcaagtgctaatcgaagtaagtatctattttatttcttacttcaaaccataatgataattctgcaaaaaccgcagaatcatcatcacctttaaattaagaactaaaatctagcagtctccttaatttaaaggtgaggtagtcactaaa

SEQ ID NO: 16398 - RNA, 153 nt, unidentified
  source 1..153: mol_type = other RNA; note = Related to NZ_AVBF01000002.1; note = Pontibacillus yanchengensis
atgggtgactagacttttagcaagtgctaatcgaagtaagtatgtattgaattcttatttcaaaagagaaatggtaattctgtagaaaccaacagaatcaccatacccctttaaattaacaattcataatttaaaggggaggtagtcacctaa

SEQ ID NO: 16399 - RNA, 168 nt, Bacillus sp.
  source 1..168: mol_type = other RNA; note = Related to JH792149.1; note = Bacillus cereus
agtggtgactagacttttagcaagtgctaatcgaagtaagtatgtatttaattcttatttcaaaaccataatgatgattctgcccaaaattgcagaaccatcctcacctttaaattaagaattaaaaccctaagagcttcttaatttaaaggtgaagtagtcactaaa

SEQ ID NO: 16400 - RNA, 166 nt, unidentified
  source 1..166: mol_type = other RNA; note = Related to NZ_FODJ01000007.1; note = Amphibacillus marinus
gatggtgactagacttttagcaagtgctaatcgaagtaagtgtgtacttaattcttacttcaatatcaatgataattctgcaaaaagcgcagaatcatcattcacctttaaattaagaattaaaaccttaagagcttcttaatttgaaggtgaagtagtcactatt

SEQ ID NO: 16401 - RNA, 165 nt, Bacillus sp.
  source 1..165: mol_type = other RNA; note = Related to CP035226.1; note = Bacillus subtilis
gttggtgactagacttttagcaagtgctaatcgaagtaagtatgtatttaattcttatttcaaaatcaatgataattctgcaaaaaccgcagaatcatcatcacctttaaattaagaattaaaaccttaagagcttcttaatttaaaggtgaagtagtcactaaa

SEQ ID NO: 16402 - RNA, 168 nt, unidentified
  source 1..168: mol_type = other RNA; note = Related to JACHHE010000004.1; note = Planococcus koreensis
aatagtgactagacttttagcaagtgctaatcgaagtaagtatgtacttaattcttacttcaaaaccctaatgataattctgcaaaaagacgcagaatcatcatcacctttaaattaagaattaaaacactaaaagcttcttaatttaaaggtgaagtagtcactaaa

SEQ ID NO: 16403 - RNA, 171 nt, Bacillus sp.
  source 1..171: mol_type = other RNA; note = Related to NVGO01000019.1; note = Bacillus toyonensis
tatagtgactagacttttagcaagtgctaatcgaagtgagtatgtattaagtcttacttcaaaacataagtacaattctgctccgcttctcttcgcaggatcgtactcacctttaaattaagacttaaaacctaaaaaacgtcttaatttaaaggtgaagtagtcactata

SEQ ID NO: 16404 - RNA, 135 nt, unidentified
  source 1..135: mol_type = other RNA; note = Related to BJZH01000076.1; note = Companilactobacillus nantensis
gagggtagttagcaatctatagcaatgtgctatagtaggtagtttctatcttaatcagtgatgtcatcaaactgaaagcgagtttgatgacggctctgtttaagaaggacgcttaaacagaccgtaactaccctt

SEQ ID NO: 16405 - RNA, 150 nt, unidentified
  source 1..150: mol_type = other RNA; note = Oscillospiraceae bacterium; note = Related to SVLF01000041.1
gaaacgcattagcctgaggtgtattcgcctcatatacagaacggcactaactctcatacagaccagcgaaacctgccttccttcgcgcgttgttttcgctgttctgtatgcgacaagaataagtaaaataagtttttcgtaatgcgtttc

SEQ ID NO: 16406 - RNA, 150 nt, unidentified
  source 1..150: mol_type = other RNA; note = Clostridia bacterium; note = Related to JAFSGO010000067.1
ggagaccgttagctaagaggtgtattcgcctcgtgttaagaacggcactaacagatgttgctgagcgcttacgcgttctcttcgttctctttgtaaccgctctgcaacatcgaatgtttgaatttagtttcattttacgtagcggtctcc

SEQ ID NO: 16407 - RNA, 132 nt, unidentified
  source 1..132: mol_type = other RNA; note = Related to NZ_JHXF01000028.1; note = Ruminococcus flavefaciens
gacattcaatagcatgggagcgattcgccccaataaagaaaggcacttactttatctaacaaatccgtcactacgttccgtatttgttagataagcgtcgcaaacgacgctttgattttcgtattgaatgtc

SEQ ID NO: 16408 - RNA, 153 nt, unidentified
  source 1..153: mol_type = other RNA; note = Related to NZ_CP094682.1; note = Anaerotruncus colihominis
gggaacgatcagaccggggtgaattcgccccttgatcaaacggcactaaccactgtttgccgtgcgtgcgtcttgttcatttcattctctgcgacgcacgcacggcaaacagacagatccattattattacaatttatttagtgatcgttccc

SEQ ID NO: 16409 - RNA, 145 nt, unidentified
  source 1..145: mol_type = other RNA; note = Related to CABHNM010000079.1; note = Dorea longicatena
aagagtaattgaattgaggtgtagtcgcctccttgatgaaggtggctaacatccgagcggaacaggttgctcgctcattgcattcgttcgtaacctgccccgctcgaatgattttggtcgcttttatgatactacaattactctt

SEQ ID NO: 16410 - RNA, 152 nt, unidentified
  source 1..152: mol_type = other RNA; note = Related to JAFVDW010000052.1; note = Lachnospiraceae bacterium
aagagtaactggattgaggtgtagtcgcctccttgagcaaaggcactaacatcgcaatagaatcaacttgttcgccgcatagggcttcggcgaacaagtcgtttctattgcgttgcgtggtgaaagcattgatttattaagcagttactctt

SEQ ID NO: 16411 - RNA, 122 nt, unidentified
  source 1..122: mol_type = other RNA; note = Related to NC_015275.1; note = Cellulosilyticum lentocellum
aagagcaactagattgaggcgattcgcctccttggaaaagggtactaagtttctgtcgcacaccaatttataagcttataaattggtgtgcgacagaaatgaaataaatagtagttgctctt

SEQ ID NO: 16412 - RNA, 144 nt, unidentified
  source 1..144: mol_type = other RNA; note = Related to QULM01000001.1; note = Coprococcus sp.
agggataactagattggggtgcattcgcctccttgcaaaacgtaactaactctttaatttacaaagccactttgcgtgaaaagcatacgcaaagtggcttgcaaatcaaagatttgcaagttccaatttcaagtagttgtccct

SEQ ID NO: 16413 - RNA, 128 nt, unidentified
  source 1..128: mol_type = other RNA; note = Lachnospiraceae bacterium KM106-2; note = Related to AP018794.1
ataagcagctagaagtgagagcgagtcgcctctataaagaacggtactaactctctaaattttacggcctttacctgcggtaaagcccgatagatctagagaagttaccatgacaggtagctgctttt

SEQ ID NO: 16414 - RNA, 154 nt, Vibrio sp.
  source 1..154: mol_type = other RNA; note = Related to JAJSDZ010000009.1
cctttagcgagttgttttttgagaaatccaaaatacaactgggtagtgattcgctgtccttcaactaaaccggaacattggctcatttagttcttgctcgctgaaacttcgtttcagactcgcaaggtctaaacgagaacttttgacgtaaagg

SEQ ID NO: 16415 - RNA, 155 nt, Vibrio parahaemolyticus
  source 1..155: mol_type = other RNA; note = Related to MIQX01000067.1
cctttagcgagttgattttcgaaaaagtcgggaatacaactgggtagtgattcgctgtccttcaggaaaacagatatattagctcatttagttcttgctcgctaaaacttcgttttagactcgcaagttctaaatgtgaacttttgacgtaaagg

SEQ ID NO: 16416 - RNA, 157 nt, unidentified
  source 1..157: mol_type = other RNA; note = Related to CP076406.1; note = Providencia rettgeri
cctttagcgagttggtttttgagaaatcaggaattcaactgggtagtgattcgctgtccttcaattaaactggttaaatggctcatttagctcttgctcactaaaacaccccggttttagattcgcaagttctaaatgagaacttatgacgtaaagg

SEQ ID NO: 16417 - RNA, 154 nt, unidentified
  source 1..154: mol_type = other RNA; note = Related to NZ_WTLA01000004.1; note = Pseudoalteromonas sp.
cctttagcgagttgttttctgataaatcagaaatacggctgggtagtgattcgctgtccatcagttaagccattaaattgacgtatttagttcttgctcgctaaaactacgttttagactcgcaagttctaaattcgatattatgacgtaaagg

SEQ ID NO: 16418 - RNA, 155 nt, unidentified
  source 1..155: mol_type = other RNA; note = Related to CP034073.1; note = Shewanella psychromarinicola
cctttagcgagttgttttttgaaactatcaataaagcaactgggtagtgattcgctatccttcaacaaaaccagatgaatagctcatttagttcttgctcgcaaaaactccgtttttgactcgcaagttctaaatgcgaacttgtgacgtaaagg

SEQ ID NO: 16419 - RNA, 155 nt, unidentified
  source 1..155: mol_type = other RNA; note = Related to JAESPX010000111.1; note = Colwellia sp.
cctttagcgagttgtatttcgaaaaattaggaatatcaactgggtagttgtttcgctgtccttcaattaaactggtttattaactaattaagttcttacccagaaaaacttcgtttttcagtgcaaggtcttaattagatcttatgacgtaaagg

SEQ ID NO: 16420 - RNA, 143 nt, Enterobacter sp.
  source 1..143: mol_type = other RNA; note = Related to FKGF01000007.1; note = Enterobacter kobei
cctttagcgagtgaattttcactgaacagtgcttcgctgttccgcaacaaaactggtgtaatgccggctcttaatgttcggagccgcacgctcctcgcgtgctgatccgaacattaatctcctatgatcttttggcgtaaagg

SEQ ID NO: 16421 - RNA, 145 nt, Acinetobacter sp.
  source 1..145: mol_type = other RNA; note = Related to DADBIP010000003.1; note = Acinetobacter baumannii
cccttagcgagtgagcgtaatactcactggatagtgattcgctatcctgcaattaatcttttacaatgctttatttaaagctacccagcaataaacgccccgtttattgccatgtacctttaaataacttcttatgacgtaaggg

SEQ ID NO: 16422 - RNA, 143 nt, unidentified
  source 1..143: mol_type = other RNA; note = Related to CU207211.1; note = Herminiimonas arsenicoxydans
cctttagctagtgaatgaaaattcactggatagtgtttcgctatcctgcattaaatccaagtcaatgccgtatttaattgttcctctcaaccatcgcccgatgtttggtcggaacacttaaatcgattctttagccgtaaagg

SEQ ID NO: 16423 - RNA, 143 nt, unidentified
  source 1..143: mol_type = other RNA; note = Related to SNWT01000002.1; note = Idiomarina sp.
cttttagcaaacagacgtcagtctgttggacggcgcttcgccgccctagtaataatctagtgtctgctgttttaaaatctgtacctcaagtatctctcgatacttgatctacaccttttaacacatttctttagacgtaaaag

SEQ ID NO: 16424 - RNA, 144 nt, Aeromonas sp.
  source 1..144: mol_type = other RNA; note = Related to NZ_CP047155.1; note = Aeromonas veronii
cccttagcgagtgaaccttggttcattggatagcgtttcgctgtcctgcacacaatctgagctattgctgcatttaactgtgcagagccagaaacatccgtttcttgatctgcacagttaaacttgatacttaagacgtaaggg

SEQ ID NO: 16425 - RNA, 142 nt, unidentified
  source 1..142: mol_type = other RNA; note = Related to JAHKPR010000010.1; note = Colwellia sp.
tccttagcgagtgaggtcaaactcactgggtagtgtttcgctatcctgcacataaactagaacaatgccgcatataaatatgcagaacaagcgactcgtcgcttgagctgcatttttatatccagaacttaagacgtaagga

SEQ ID NO: 16426 - RNA, 149 nt, Vibrio parahaemolyticus
  source 1..149: mol_type = other RNA; note = Related to CP006004.1
cccttagcacatagtgtactttttgttcactggatagcgtttcgctgtcctgtactaaatccagttcaatatcgtatttcactgtgccgagcaagaagacattcgtttcttgaacggcacagtgaaattcgtaaatttagacgtaaggg

SEQ ID NO: 16427 - RNA, 148 nt, Vibrio sp.
  source 1..148: mol_type = other RNA; note = Related to NZ_AP018689.1; note = Vibrio aphrogenes
cccttagcgaatgagcttacttagttcattggatagcgtttcgctatcctgcatacaatctgattcaatgccgcatgaaaatgtgcagagccagaatacagtagtttctggaactgcacattttcatccgcgacttaagacgtaaggg

SEQ ID NO: 16428 - RNA, 146 nt, Proteus sp.
  source 1..146: mol_type = other RNA; note = Related to NZ_CP034105.1
cccttagcgaatgaacataatgttcattggatagcgtttcgctatcctgcacataatctgattttatgccgtatgaaaatgtgcatcaccagaataccgtagtttctggatctgcacattttcctccgcgtcttgaggcgtaaggg

SEQ ID NO: 16429 - RNA, 146 nt, unidentified
  source 1..146: mol_type = other RNA; note = Related to NZ_BAEK01000003.1; note = Paraglaciecola agarilytica
tctttagcgagtgggtgaatagccctctggatagtgtttcgctatcctgcgaacaatcttgcaccatgccgaatgtaatggtgcctagaaagaaaaagtcttttcttgtccaggcaccattacatccgtttcttaagtcgtaaagg

SEQ ID NO: 16430 - RNA, 145 nt, Nitrosomonas sp.
  source 1..145: mol_type = other RNA; note = Related to FOFX01000033.1
cctttagcgagtgggtgctaaactcactgggtagagtttcgctatccgacactaaatctagaatcatgccgtatatatacttgcttcacaatcatctcccgatgattgatcagcaagtttatatccgatacttatgacgtaaagg

SEQ ID NO: 16431 - RNA, 145 nt, unidentified
  source 1..145: mol_type = other RNA; note = Related to BMLH01000001.1; note = Rheinheimera tangshanensis
cctttagcgagtgggtcaagtactcactgggtagtgtttcgctatcctgcactaaatccagaagcatgccgtatataaatatgctgcacaatcatcgctcgatgattgcaccgcatttttatatccgattctttagacgtaaagg

SEQ ID NO: 16432 - RNA, 145 nt, unidentified
  source 1..145: mol_type = other RNA; note = Related to NZ_VBVC01000001.1; note = Halomonas sp.
cctttagcgagtgggcttagcgctcactgggttgcgcttcgcttccctgcacgaaatctggagctttagcgtatctaaagctgcggcacaatcatctctcgatgattgcaccgcgtctttatatccgtttcttaagacgtaaagg

SEQ ID NO: 16433 - RNA, 149 nt, Escherichia coli
  source 1..149: mol_type = other RNA; note = Related to UGCT01000004.1
cccttagcgagtggcttctccggaagttcactggacagtgtttcgctgtcctacatacaatctgaagttttaccagttccctcattgaaaggagaacatctcccgatgttctcctttcacttcggaatctgatttttatgacgtaaggg

SEQ ID NO: 16434 - RNA, 178 nt, unidentified
  source 1..178: mol_type = other RNA; note = Related to NZ_SOZF01000025.1; note = Serratia oryzae
cccttagcgagtagttttctgatgatagctgctggatgcggtttaatgatgagggctactggatagtgtttcgctgtcccacacaaaatctgaagtactgccagtccctacagttgcacgaagaacatcccctgatgttcttcgtgaacttcgggagctgttttttatgacgtaaggg

SEQ ID NO: 16435 - RNA, 147 nt, unidentified
  source 1..147: mol_type = other RNA; note = Related to NWTM01000001.1; note = Pectobacterium sp.
cccttagcgagtcccttgtaagaggtgactggatagtgtctcgctgtcctgcattaaatctactgttttggcagtttacctcgaactcagagaacatctcccgatgttctctgagagcgaggaaacctggtatttatgacgtaaggg

SEQ ID NO: 16436 - RNA, 157 nt, unidentified
  source 1..157: mol_type = other RNA; note = Related to NZ_CP033893.1; note = Serratia liquefaciens
cccttagcgagaggcttaccattcgtgggaacctctggatgctgattcggcatcctgcatgtaatctgagttactgtctgctttccttgttggaacggagagcatcgcttgatgctctccgagccaaccaggaaacccgtcttttttgacgtaaggg

SEQ ID NO: 16437 - RNA, 155 nt, unidentified
  source 1..155: mol_type = other RNA; note = Related to NZ_CAAGXM010000002.1; note = Klebsiella quasipneumoniae
cccttagcgagaggtacttcattcgtgattgcctctgggcgttgtttcggcgtcctgcaactaaactcagtttctgtctgctttccttgtggaacggagagcatcagtggatgctctccgagccacaatgaaatccgttttttttgacgtaaggg

SEQ ID NO: 16438 - RNA, 160 nt, unidentified
  source 1..160: mol_type = other RNA; note = Related to JADTXC010000013.1; note = Serratia ureilytica
cccttagcgagaagtgacttcatgataaaatgagccactttctggatagtgcttcgctatcctgcatttaatcttgttcaatagcagctttcgatgtgaacgacgaacacctctccgtgttcgtcgatcacatcgaaatcagtaacttaaggcgtaaggg

SEQ ID NO: 16439 - RNA, 161 nt, unidentified
  source 1..161: mol_type = other RNA; note = Related to NZ_CGCI01000022.1; note = Yersinia frederiksenii
cccttagcgagaggtagtgatcatttagttgtgagctactttctggatagtgattcgctgtcctgcatttaatctgattcaatagcagctttcaatgtgaacgacgacgacctctcggtagtcgtcgatcacatcgaaaaccgaaacttaaggcgtaaggg

SEQ ID NO: 16440 - RNA, 142 nt, unidentified
  source 1..142: mol_type = other RNA; note = Related to NZ_JAENGP010000011.1; note = Advenella mandrilli
tctttagccgagcgagttgttctcgctggatagtgtttcgctgtcctgcattaaatccaactttatgccgcatgcaaatcttcacaatacctcgcctgaggtattgcctcagatttgcatacgtgcttttaagacgtaagga

SEQ ID NO: 16441 - RNA, 149 nt, Aeromonas hydrophila
  source 1..149: mol_type = other RNA; note = Related to NZ_CP065651.1
tctctagcgagtgggaatttcccgctggatggtgtttcgccatcccacagataatccagaccattgttggccaatgagtttcaatgtgcggagcaagcgctaccgcgcttgaaccgcacattgaaacgagtattcttaagccgtagaga

SEQ ID NO: 16442 - RNA, 141 nt, unidentified
  source 1..141: mol_type = other RNA; note = Related to NZ_BBUL01000097.1; note = Cellvibrio sp.
cctttagcgagtgagcatgctcactggatgttgattatcgccatcctacacaaaaccattgtcaatgcggcttaatttgactatcgaagcacgttccgtgcttcaacagtcaaattaacccatatctaagttacgtaaagg

SEQ ID NO: 16443 - RNA, 156 nt, unidentified
  source 1..156: mol_type = other RNA; note = Crocinitomicaceae bacterium; note = Related to JAESQK010000141.1
tctttagcgagaggtctagcaatagatcgctagtggatggtgtttcgccatcccaagggaaagctgttggatcggcgagagttttctcgggaaaactctcgtccctcaagttctcccgagaaagctctcttccgcaccaattttgtgacgtaaaga

SEQ ID NO: 16444 - RNA, 141 nt, Flavobacterium sp.
  source 1..141: mol_type = other RNA; note = Related to NZ_JAGFBU010000005.1
attttagacgtgttttcattaatacgcgtggttgttgttccgacaatcgagttttaaactcatttttatcatcacaaattttaaacagaaaatcaaaatgatttcctatttaaatttcgctcaagaattttgatgtaaaat

SEQ ID NO: 16445 - RNA, 152 nt, Flavobacterium sp.
  source 1..152: mol_type = other RNA; note = Related to NZ_FOJT01000006.1; note = Flavobacterium swingsii
attttagacgcgatttgtatttatatatttcagcgagtggttgttgttccgacaaccgagttttaaactcatttttataatcgcaaattttaaattagaaaatccggtaggtttgctaatttaaatttcactcaaatgttatgaagtaaaat

SEQ ID NO: 16446 - RNA, 140 nt, unidentified
  source 1..140: mol_type = other RNA; note = Bacteroidetes bacterium; note = Related to JABHCC010000144.1
tttttagacgttgtttatcagcgagtgggtgttgttccggcacccgagttttaaactaagctttattatcgcaaattctaaatttttaaatccagttggtttaataatatagaattcactcaaattttgagaagtaaaaa

SEQ ID NO: 16447 - RNA, 160 nt, Flavobacterium sp.
  source 1..160: mol_type = other RNA; note = Related to NZ_VOGZ02000014.1
tttttagacgcttagtaaattgtgttatgcaattgaaaatgcgagtggatgttgtttcggcatccgagttctaaactcaactttatcatcgcaaactttcatcgcaaagcttcaatgaagcttcacaatgaaacttcactcaaaaattgtgaagtaaaaa

SEQ ID NO: 16448 - RNA, 131 nt, unidentified
  source 1..131: mol_type = other RNA; note = Related to NZ_CP042433.1; note = Flavisolibacter ginsenosidimutans
tttttagacacttcggtgagtgaatgttgttccagcattcgagtttaaaactaaccattataatcacgaatttttgatacaaatccagttggtttatatcaaaacttcgttcaaatgtaaagtagtaaaaa

SEQ ID NO: 16449 - RNA, 131 nt, unidentified
  source 1..131: mol_type = other RNA; note = Planctomycetes bacterium; note = Related to JACRII010000139.1
tttttagacacttcggtagtggatgttgtttcggcatccgagttttaaacaaaactttatcatcgcaaatttatatgtttctttgtttcctcagaaacatataaattcactcaaatgttttgaagtaaaaa

SEQ ID NO: 16450 - RNA, 134 nt, unidentified
  source 1..134: mol_type = other RNA; note = Related to SEFI01000651.1; note = Sphingobacteriaceae bacterium
tttttagacacttcggtggtgggcgctgttccggcgctcgaggctaaaactcagctttattatcgcaaaattcctctctttcctcctgaacgtcgcaaagagaggaatttcactcaaaatttttgaggtaaaga

SEQ ID NO: 16451 - RNA, 158 nt, unidentified
  source 1..158: mol_type = other RNA; note = Related to NZ_JHXV01000023.1; note = Crocinitomix catalasitica
tttttagacgctttttgttgcgttatgtaattaaaaagtgagtgagtgttgttccgacactcgagttataaacctagatactatcatcgcaaattttaagtgcaaaatccagtaggttttacacttaaatttcactcaactattgagaagtattaaga

SEQ ID NO: 16452 - RNA, 144 nt, unidentified
  source 1..144: mol_type = other RNA; note = Related to JAJMPA010000005.1; note = Pedobacter sp.
attttagacatttggtttaccaaatattgggacgttgtttcggcgtccaagaattaaacttagctttatcttccaaaagtatgaagctattgactcgattcctcgcaacatcttcatacttccgtctagtattatgagtaaaaa

SEQ ID NO: 16453 - RNA, 131 nt, unidentified
  source 1..131: mol_type = other RNA; note = Nitrospirae bacterium; note = Related to WPIF01000004.1
tctttagtcgcttcggcgagatgttgattcgacatccaaggtgtaaactaactattgtcttcatgaagttggcactttaatctctcaacgagattaaagtggaacttcattcaagaattttgaggtaaaga

SEQ ID NO: 16454 - RNA, 134 nt, unidentified
  source 1..134: mol_type = other RNA; note = Related to NZ_FSRK01000003.1; note = Epilithonimonas zeae
tatttagaccattttttggagaatagtggttcgctattcgagaagtaaaactatattttatttgtgcaattaaaataatttcctgcgggcactcgaaaattattttaatcacgtaagactttagaaagtaaata

SEQ ID NO: 16455 - RNA, 148 nt, unidentified
  source 1..148: mol_type = other RNA; note = Related to JAIBBL010000001.1; note = Ignavibacteria bacterium
attttagaaaagttctttttagtcgtatgttgggtgttgttcacgacacccctgatcaattgcaacatttagtttcgaaaacttttaatgtaaatgcaggcacagctgatttacattaaaacttctctcaagaattaagaagtaaaaa

SEQ ID NO: 16456 - RNA, 154 nt, unidentified
  source 1..154: mol_type = other RNA; note = Related to JABHDM010000238.1; note = Nitrospina sp.
ttcttagccagaccaagctgggttgccattttggtctgagcggtgattcgccgctctagatgaaaactttggtttatcgtattaatgtttaattgcttctacctcagtttgaggtaggcgcattaaacattaacaattatttttgaagtaagaa

SEQ ID NO: 16457 - RNA, 122 nt, unidentified
  source 1..122: mol_type = other RNA; note = Related to JACDNW010000012.1; note = Candidatus Marinimicrobia bacterium
attttagtcggctattatagcctgggcagtgttttcgctgtccgtgaagaaaactcctcactgtttctctcaaattatgccctctcgggcataatttgagagtcggatttatgaagtaaaat

SEQ ID NO: 16458 - RNA, 123 nt, unidentified
  source 1..123: mol_type = other RNA; note = Related to JAHJJL010000216.1; note = Candidatus Eisenbacteria bacterium
gctttagtcggtcgcttgcgacctgtggacgatgattcgtcgtccgaggtggaaacagagcattattgcggtcaaattgcgacttatggtcgcaattcaaacgcttctcttgtgaagtaaagt

SEQ ID NO: 16459 - RNA, 134 nt, unidentified
  source 1..134: mol_type = other RNA; note = Chloroflexi bacterium; note = Related to QQUH01000007.1
cccttagacgatgcttgcatcagtgggtgatgattcgtcgcccgaggctaaaaccagttcattatttgcaagcgaacacccaccatggctccgccatggattaagttcgcttgcattggtggttgaagtaaggg

SEQ ID NO: 16460 - RNA, 136 nt, Bacillus sp.
  source 1..136: mol_type = other RNA; note = Related to WBOQ01000050.1
tacttagaaccaagctttttttggatagtgtttcgctatccacagttaaaactcgtgtttaacctacgcaataaacacacaatgagtatcgccatactcattgaatgtttattgctcggattatttatggtaagta

SEQ ID NO: 16461 - RNA, 142 nt, Bacillus sp.
  source 1..142: mol_type = other RNA; note = Related to JAIUXW010000030.1; note = Bacillus toyonensis
tacttagaaccaagctttttttttggggatagtgattcgctatccttagttcaaactcgctattaaccttatatcaataagcacacaatgagtatagccatactcatcgtgcacttattgaccggattatttatggtaagta

SEQ ID NO: 16462 - RNA, 135 nt, Bacillus sp.
  source 1..135: mol_type = other RNA; note = Related to NTXH01000057.1; note = Bacillus cereus
tgcttagaaccaagcttgttaaaggatagtgtttcgctagcctagtaaaatctctgttatacctatatcaataacagaaaatctatatctccatatatattttctgttattgatcgagactatttatggtaagca

SEQ ID NO: 16463 - RNA, 136 nt, unidentified
  source 1..136: mol_type = other RNA; note = Related to NZ_NPBP01000019.1; note = Terribacillus saccharophilus
tgcttagaaacctacttttaccgatagtgattcgctatcgtagtaaattacatgcttttcaaccatggctgttaaaccccctcgtttcaccaggaaacaagttgatttaacagccaaggcttacttatggtaagta

SEQ ID NO: 16464 - RNA, 137 nt, unidentified
  source 1..137: mol_type = other RNA; note = Bacillaceae bacterium JMAK1; note = Related to JIBW01000002.1
tgcttagaaatcaatattaatcgatagtgttccgctgtcgtagtttataaatcgcttttaaccattactgttaggaacaaattgcttcctccgaaccaatattgatcctaacagcaaaggcttatttatggtaagtg

SEQ ID NO: 16465 - RNA, 138 nt, Bacillus sp.
  source 1..138: mol_type = other RNA; note = Related to PYWO01000004.1; note = Bacillus subtilis
tgcttagatatcattaatttaagaacagtgtttcgctgttctagtatattaacatctttttttctttctatgataaacacaacgctattcaacctgaatatcgttgcatttatccaagaagtttatttatggtaagca

SEQ ID NO: 16466 - RNA, 171 nt, unidentified
  source 1..171: mol_type = other RNA; note = Related to NZ_JAGXBY010000001.1; note = Ornithinibacillus sp.
ggcttagttaatattatttttctttttacatattacaatttagaaggaaaataataggagtagtgattcgctattctttaattaaacttcaggtttagcttttaaacaaatatgcggctatattttccaaatatcccctcacatttgtttaaaatgtccttagggtaagcc

SEQ ID NO: 16467 - RNA, 131 nt, unidentified
  source 1..131: mol_type = other RNA; note = ANME-1 cluster archaeon GoMg2; note = Related to QBUM01000164.1
atctcagatgagcttcggctagaggatggtgcttcgccatcccagatgaaatcgcctccattgtttcgattgaatcttacgtacaggcctcctgtacgcaaccttcaatccactgtattttagagtgagat

SEQ ID NO: 16468 - RNA, 131 nt, unidentified
  source 1..131: mol_type = other RNA; note = Related to MGVG01000053.1; note = Elusimicrobia bacterium RIFOXYA2_FULL_53_38
aatttagaaagagagggggtggtgccttcgccgccctaggtgcagaacatcctagaagttccgctagaattcagccaatctcgcagtagcagcgattggatgaattctagcagtatgtttgtgagtaaatt

SEQ ID NO: 16469 - RNA, 149 nt, unidentified
  source 1..149: mol_type = other RNA; note = Related to MZGT01000125.1; note = Clostridium chromiireducens
ggcttagaacgttaaggtgcatttctttaactgggtagtgtttcgctactctggatggatactgaatattattttagtaaacaatcatgcttcttaaaagagcaattttaagaagcacaattgtttactaatagctaattgtgtaagct

SEQ ID NO: 16470 - RNA, 169 nt, unidentified
  source 1..169: mol_type = other RNA; note = Related to JAJAXF010000024.1; note = Laribacter hongkongensis
tctctagcgggcctaaccaagttcaagccgagcttgcaacaaggttcaagccggatagtgcttcgctatccaacactgccgtggtgagatggtcattcccgtataacacggagaatggccccaccattctccgtgttatacgggaatgatagatcttttgtcgtaggga

SEQ ID NO: 16471 - RNA, 179 nt, unidentified
  source 1..179: mol_type = other RNA; note = Related to NZ_MWJI01000004.1; note = Paraclostridium bifermentans
tctttagagaacactatttaagttactataggtgcgcatattatatagtacttattgtagttagagatgattcgtctctgttagaatttaagtgtattaatatttcattaattgtttcacttcatccacggtcaagtgaatgaattaaaacaattaattcaaaagatttatggtaaggg

SEQ ID NO: 16472 - RNA, 180 nt, unidentified
  source 1..180: mol_type = other RNA; note = Related to CP037830.1; note = Clostridioides difficile
tctttagagaacactgttataagttgctatagatgcgcatgttatatggtacttattatagttagagatgattcgtctctgttagaatttaagtgtatttatatttcgtaattgtttcaatttattcaacattaagtatgaaaaattgaaacaattaactcaaaagatttatggtaagga

SEQ ID NO: 16473 - RNA, 178 nt, unidentified
  source 1..178: mol_type = other RNA; note = Related to NZ_CABIXZ010000002.1; note = Intestinibacter bartlettii
cccttagaaaacactatataaatttacaaagcgcgcaaattttgtaagtttatttagttggagatgattcgtctctgtctgaaaacaaagtatactgatatatcattaaatatttgatacatttgtcaatccaacaaatgtatcttcatatttaattcaaagaattaagtggtaaggg

SEQ ID NO: 16474 - RNA, 171 nt, unidentified
  source 1..171: mol_type = other RNA; note = Related to NZ_BHYK01000003.1; note = Clostridium tagluense
cctttagagaccactatataatagtattgatcataaaagtactcctatttatagttggagatgattcgtctccctaagtgtttaatttagtagtatcttaattaaatgttccaatccatccacattgtgaatgaattaaaacatttaatcaagaatgatttatggtaaagg

SEQ ID NO: 16475 - RNA, 177 nt, unidentified
  source 1..177: mol_type = other RNA; note = Related to JACBEK010000003.1; note = Clostridium botulinum
tctttagagaacactatatgataaatttatttcgcgatataatatttttattattatagttgaggatgattcgtcttcttatgaattaactatagagtatttcaattaaatagctcaaatcatccacagtagtgaataatttaatctatttaatcgaaaaagtataaatggtaaaga

SEQ ID NO: 16476 - RNA, 169 nt, unidentified
  source 1..169: mol_type = other RNA; note = Related to NZ_JZJQ01000041.1; note = Clostridium sporogenes
cctttagaaagcactatgttgtagcaataatagtactagctattttcatagtcgaagatgatacgtcttcataagaatttagtagagcattatttaaattaaatcgatgaactcatccacaacagtgaatgacttaatcgatttaatctaaaaagatttatggtaaagg

SEQ ID NO: 16477 - RNA, 169 nt, unidentified
  source 1..169: mol_type = other RNA; note = Related to NZ_FQXP01000010.1; note = Clostridium collagenovorans
cctttagaaagcactatgttgtaacaaaaatagtactagttatttgcatagtcgaagatgattcgtcttcataagtatatagcaaaatataatttaaattaaatcgattaattcattcacagctgtgaataacttaaacgatttaatctaaaaagatttatggtaaagg

SEQ ID NO: 16478 - RNA, 150 nt, unidentified
  source 1..150: mol_type = other RNA; note = Clostridiales bacterium; note = Related to JAGZKV010000024.1
ttttcagttaatacatattgcagcgcaatgtgttcggaagatgattcgatcttctttggtgaatggttatacatgattcagccagtttagacgtctaaaccacagaagtggaatagccgtctaaactatatgaaagatttatggtgaaag

SEQ ID NO: 16479 - RNA, 152 nt, unidentified
  source 1..152: mol_type = other RNA; note = Related to PYLO01000002.1; note = Clostridium fessum
tttttagtttatacataacgtattattacattgtgttcggaagaagattcttgcttccttggtgtatggtccacatgattcgttatgcttagcagtatagttcatagtcatgaattatccagctaaccctaacgaaaaacttatggtgaaag

SEQ ID NO: 16480 - RNA, 149 nt, unidentified
  source 1..149: mol_type = other RNA; note = Clostridia bacterium; note = Related to JAFQFZ010000002.1
cttttagctattacatattgttttcaatatgttcggaaggcgattcgccttccttggtggatgattccacacgattccttaactttagccgtctatctcacatcgagtgaaatagacaactaaacttaacgaaaagtttctggtaaaag

SEQ ID NO: 16481 - RNA, 161 nt, unidentified
  source 1..161: mol_type = other RNA; note = Related to NZ_WIQR01000001.1; note = Pectinatus frisingensis
cttttagtcttgcatattgttatgttaatatgctttggaagatgtttcgtcttcttaggtcttaatgctctcattattccctattgcttaatcgctaatgccacattcgtggcatcatcaactaatcaatagcgaaatgtaagttcggtaatcggtaaaag

SEQ ID NO: 16482 - RNA, 150 nt, unidentified
  source 1..150: mol_type = other RNA; note = Firmicutes bacterium HGW-Firmicutes-4; note = Related to PGZR01000048.1
cctttagatttagcatattaaatttaatatgcgttggaagatgattcaatcttctgtagcgtaacatcgtacatgattagcttaatttaactagatactccacatacgtgaagcatctagccaaattaatcaaaagaattaaggtgaagg

SEQ ID NO: 16483 - RNA, 166 nt, unidentified
  source 1..166: mol_type = other RNA; note = Siphoviridae sp.; note = Related to BK019570.1
cttttagtttttacaattctttatgtaagtctacatattttattgttttggacggtgattcgccagtccttggttaaacgcttactcacaattcgtgatataaaacattttattaaagcacttgtttcaataaaatttttatctcacgaaagacttatggtaaaag

SEQ ID NO: 16484 - RNA, 176 nt, Bacillus sp.
  source 1..176: mol_type = other RNA; note = Related to NULM01000015.1; note = Bacillus thuringiensis
ctcttagatgttgcacttaattcatatagtgtgcacatatttattatgttttaggtgttgggagatgattcgtcttccagaatggtatattatgcatgatttttcaaaagtaagtgtctaaatccacaaaggtgaattcatacacttacttttaaaaaaaagacttagggtaaggg

SEQ ID NO: 16485 - RNA, 177 nt, Bacillus sp.
  source 1..177: mol_type = other RNA; note = Related to NZ_CP035996.1; note = Bacillus mycoides
ctcttagacgttacgcttaactcataggttgtgcacatattggttatgttttaggtgttggggagatgattcgtcttccagaattttatatcaagcatgatttttcaaaagtaagcgtttaactccacaaaggtgaagtcatccacttacttgtgaaaaaaagattaaaggtaaggg

SEQ ID NO: 16486 - RNA, 177 nt, Bacillus sp.
  source 1..177: mol_type = other RNA; note = Related to NVKK01000033.1; note = Bacillus thuringiensis
ctcttagatgttacttcttaattcataaattgcgcatatatttattatgttttaagtagtggaagatggttcgtcttctaaagttttatgtcagacatgatttttcaaaataaatcgtgtaacttcacaaaggtgaagtcacacgattcatttagaaaaaattaccaaaggtaaggg

SEQ ID NO: 16487 - RNA, 178 nt, Bacillus sp.
  source 1..178: mol_type = other RNA; note = Related to NVCK01000005.1; note = Bacillus thuringiensis
ctcttagatgatactgactaaattcataattatgtacattattttatgatttggttatgtgggagatgattcgtcttctattgtgctaagtgagaactagatttaccagaagaaagtccattacttcaccctcgtgaagcaacaaactttcttctgataaaaggattttaggtaggag

SEQ ID NO: 16488 - RNA, 174 nt, unidentified
  source 1..174: mol_type = other RNA; note = Related to NZ_BHYK01000016.1; note = Clostridium tagluense
ctcttagaagttgctaccattacataaaagtgtacataaaatttacgtataggtagtgggggacgtttcgctcttcctatgttcgatgtcaagtctgtatttttaaaagtatccgagttccttaaagacatttaagaaactcaaatacttttcaaaaagtaataagggtaagag

SEQ ID NO: 16489 - RNA, 175 nt, unidentified
  source 1..175: mol_type = other RNA; note = Related to NC_016627.1; note = Acetivibrio clariflavus
tccttagatgctactacttttgtataaacgtgcacaatatttatttatatgaaagtagtgggaagtggttcgctttccgaggtgctatgtcaggactatatttaatgaagtaagcgtccaacttcatatatatgaagttagccacttacttcatcaaaaggaataaaggtaagga

SEQ ID NO: 16490 - RNA, 178 nt, unidentified
  source 1..178: mol_type = other RNA; note = Related to VOHC01000030.1; note = Planomicrobium sp.
ctcttagatgtcactgattagatgcccaaacatgtacatggttttggagtttagttatgtgggagatggttcgtctcctgttgtgtaaagcaaggaattgattcatcagaagaaggagtaaaactccacgacagtgaagttctccaccttcttcagataaaattgtttttggtaagag

SEQ ID NO: 16491 - RNA, 177 nt, Bacillus sp.
  source 1..177: mol_type = other RNA; note = Related to NFEK01000132.1; note = Bacillus thuringiensis
cccttagatgtttctattttttctcatagatgtgcacatttatttatgtataaaaatggtcgggggatggttcgtcttcttaagtttaatactaacatgtacttgtagagagtaagtggacaactccacgacggtgaaattctccccttactctctacaaattaataaaggtaaggg

SEQ ID NO: 16492 - RNA, 151 nt, unidentified
  source 1..151: mol_type = other RNA; note = Related to NZ_AWTC01000001.1; note = Sporolactobacillus laevolacticus
tttttagaattttctctttgaaacttgaagagtgagaaatggtgattcgccattttaagtgaaatgtgagataacttatttgaataataatcctcacatttacaacgtaaatattcggctcattattcaaatatctaatgactggtaaagg

SEQ ID NO: 16493 - RNA, 179 nt, unidentified
  source 1..179: mol_type = other RNA; note = Related to BMCJ01000003.1; note = Thalassobacillus devorans
ttcttagaaattactactaatttcatgaagtgtgcacattaaattcatgctattagtatgtgggagacggttcgtcgacctttagcataacaatcaggttagatttgtggaacctgcaccttcaatctcacgacagtaagattaaaggcacatttccacaaaatgatttatggtaagga

SEQ ID NO: 16494 - RNA, 178 nt, unidentified
  source 1..178: mol_type = other RNA; note = Related to NZ_ATVM01000016.1; note = Marinococcus halotolerans
ccctcagtcattatgattggtatcggataagcgtgcacattctttaagatatcgaatcatgggggacggttcgtctaccctttgtttaaagttactattgattttcacatttatgcgttatactttcactatcgtaaaaattaacgcataattgccaaaaagttttttagggtgaggg

SEQ ID NO: 16495 - RNA, 181 nt, unidentified
  source 1..181: mol_type = other RNA; note = Related to NZ_JALIRM010000001.1; note = Lederbergia wuyishanensis
cccttagattttattgcaagttttatagagggtgcactactcaaactctataagacacggtaatgggagacggttcgtcatcctatggttaaatgacattcattattcttgatattatgtgttaaatctcacgataagtgaaattcaccccataatttcaataaattacttttggtaaggg

SEQ ID NO: 16496 - RNA, 157 nt, unidentified
  source 1..157: mol_type = other RNA; note = Clostridia bacterium; note = Related to JAFVTV010000006.1
ttcttagatcgttgcaggtgtggctacatatctgtctacgggggatggttcgtctccctgagttttttaacaaagtcagagttgctccaaatcaaggagaaactccacgacagtgaacttcctccttgatttggaggcaaagaaatagtggtaagaa

SEQ ID NO: 16497 - RNA, 159 nt, unidentified
  source 1..159: mol_type = other RNA; note = Related to FRCT01000015.1; note = Ruminococcus flavefaciens
ttcttagcctgttgaagaaagagtttctccgacttcctacggaagatggttcgtcttcctaagtttcaaacattatcatagttacacaaaagcaatgtaaaactccacgactgtgaactttaacattgctttcgcgataaaacattttttgtgtaagaa

SEQ ID NO: 16498 - RNA, 168 nt, unidentified
  source 1..168: mol_type = other RNA; note = Related to NZ_AUFC01000039.1; note = Anaerovorax odorimutans
ttcttagaacgttataggaacatactagttggtagtacatacctatttacgggaaatgattcgtttccctaagctacttagcaaatgcggaattgctccaaaatcatgagcaattccacgacagtgaaattgctcccaattttggagacaaaacactaatggtaagaa

SEQ ID NO: 16499 - RNA, 151 nt, unidentified
  source 1..151: mol_type = other RNA; note = Related to JAJEQN010000018.1; note = Lachnospiraceae bacterium CLA-AA-H224
ttcttagaacgttgcaggtacatatctgtttacggaagatggttcgtcttcctaagaaaattaacaaacacagagttactccaatcaatggagtaaccccacgacagtggatttcctccattgattggaggtaaaggatttaaggtaagga

SEQ ID NO: 16500 - RNA, 152 nt, unidentified
  source 1..152: mol_type = other RNA; note = Related to NZ_JADPGV010000001.1; note = Blautia luti
ttcttagaacgttacagatacatatctgtttacggaagatggttcgtcttcctaagaaaattaacaaacacagagttactccaatcaatggagaaactccacgacagtgaacttcctccattgattggagacaaagagatttaaggtaagga

SEQ ID NO: 16501 - RNA, 152 nt, unidentified
  source 1..152: mol_type = other RNA; note = bacterium 0.1xD8-82; note = Related to RAYQ01000024.1
atcttagagtgttacagatacatatctgtttacgggagatggttcgtcttcctaagagaattaacatatacagagttactccaatcaatggagtaactccacgacagtgaagtttctccattgattggaggtaataattattaaggtaagaa

SEQ ID NO: 16502 - RNA, 159 nt, unidentified
  source 1..159: mol_type = other RNA; note = Related to JACOPD010000001.1; note = Lachnospira sp.
atcttagaacgttactgatacatatttttgttgaagtttatggaggatggttcgtcttccggagaatatgaacatgaccagagttggtcaaaaccatggtgtaattccacgacagtgaaatcccaccatggttttgacgcaaaatatataaggtaagaa

SEQ ID NO: 16503 - RNA, 160 nt, unidentified
  source 1..160: mol_type = other RNA; note = Related to JAFQRZ010000003.1; note = Agathobacter sp.
atcttagaacgttacagatacatacttatgtagaagtttatgggagatggttcgtcttccggagcaaattaacatgaccagagttggtcaaaaccatggtgtccttccacgacagtgaaaccccaccatggttttgacgcaaaaatatttatggtaagaa

SEQ ID NO: 16504 - RNA, 159 nt, unidentified
  source 1..159: mol_type = other RNA; note = Related to JADJOK010000004.1; note = Veillonella sp.
atcttagaacgttgcagatacatatttatgtagaagtctatgggagatggttcgtcttcctgagtaaattaagataaccagagttggtcaaaaccatggtgctattccacgacagtgaaatacccccatggttttgacacaaaatatttaaggtaagaa

SEQ ID NO: 16505 - RNA, 161 nt, unidentified
  source 1..161: mol_type = other RNA; note = Lachnospiraceae bacterium; note = Related to JAFUIR010000009.1
ttcttagaacgttatggatacatatttttatgttgaagtctacggaagatggttcgtcttcctaagtaatgaaattaaaccagagtttgccacaacaatgtggctattccacaatggtgaaatacccccattgttgtggcataaaatattgaaggtaagga

SEQ ID NO: 16506 - RNA, 146 nt, unidentified
  source 1..146: mol_type = other RNA; note = Related to FRDH01000006.1; note = Butyrivibrio hungatei
atcttagatgcgttgcagcaagtgttgtgtacggaagatgattcgtcttcccaagaaaatcatttggtttagttgaataaaactagtctttatgcgcatagccatgcacataaagattgttttatccaaaatatatttggtaagaa

SEQ ID NO: 16507 - RNA, 178 nt, unidentified
  source 1..178: mol_type = other RNA; note = Related to QUES01000001.1; note = Eisenbergiella sp.
ctcttggaaacgttggttaggtattggatgtgctttggtacatatcaacctttctttaagggaaatggttcgtttcctttagattattaacttagagggtataccgcgacaagatgcgctgataagcagattactgtttatcatcacctcttgtcgtgctaaatatttttggcaaggg

SEQ ID NO: 16508 - RNA, 154 nt, unidentified
  source 1..154: mol_type = other RNA; note = Related to NZ_UFVT01000001.1; note = Blautia coccoides
ttcttagaattgttgttaatatgcatacatagcaactaggggtcgctacgacctcgtgagaataataattacatgaactcagctaaaacaacggtgaacttccacaatagtgaaactcccccgttgttttacccgaaagtacattgagtaagat

SEQ ID NO: 16509 - RNA, 154 nt, unidentified
  source 1..154: mol_type = other RNA; note = Related to JACOPE010000001.1; note = Ruminococcus sp.
ttcttagaattgttgttaatatgcatacatagcaactaggggttgtttcgacctcgtgagaataataattacatgaactcagctaaaacaacggtgaacttccacaatagtggaactcccccgttgttttacccgaaaatatattgagtaagaa

SEQ ID NO: 16510 - RNA, 154 nt, unidentified; identical to SEQ ID NO: 16509
  source 1..154: mol_type = other RNA; note = Related to JAJBQL010000016.1; note = Mediterraneibacter faecis

SEQ ID NO: 16511 - RNA, 155 nt, unidentified
  source 1..155: mol_type = other RNA; note = Related to MCGH01000001.1; note = Eisenbergiella tayi
ttcttagaattgttgttaatatgcattatataacaactaggggttgtttcgacctcaaaagaattataatcacatgtacttagctaaatcaacggtgaacttccacgacagtgaaactcccccgttgatttacccaaaatcatattgagtaaggg

SEQ ID NO: 16512 - RNA, 155 nt, unidentified
  source 1..155: mol_type = other RNA; note = Related to FMFO01000004.1; note = Roseburia sp.
ttcttagaattgttgttaatatgcattacataacaactaggggttggttcgacctcggaagaataataaacacatgaaattagctaaatcaacggtgaacttccacgacagtgaaactcccccgttgatttacccaaaaacatattgagtaagaa

SEQ ID NO: 16513 - RNA, 148 nt, unidentified
  source 1..148: mol_type = other RNA; note = Related to QXXC01000007.1; note = Clostridiaceae bacterium
cgcttagaattgttaatgtgtgctacatattgactgggagcagttcctgcttcgtttgaagaatcatgacccgtatccatcgtagtttcatgagcgaaaaatggttgtttcgatcatgaaactacgccggaaatatactgagtaagcg

SEQ ID NO: 16514 - RNA, 147 nt, unidentified
  source 1..147: mol_type = other RNA; note = Related to BMDT01000015.1; note = Enterococcus alcedinis
ttgttagatatctcccaattgggtatactagcgatgtttcgtcgctgtcagtggaatacacgcaattcgaatgttaaagtctttcccccaactcactacaaagtagtaactcgtggaaaagactttaaaagctatttttggtaatga

SEQ ID NO: 16515 - RNA, 126 nt, unidentified
  source 1..126: mol_type = other RNA; note = Related to JAEHOK010000008.1; note = Salegentibacter maritimus
cttttagaattagagtagccgttaatagtgcgatgattcgtcccactggttttaacttacatttatacaatgaattaagtgtcaaaaacgtcagagttttcaacccttaattgatttaagtaaaag

SEQ ID NO: 16516 - RNA, 127 nt, unidentified
  source 1..127: mol_type = other RNA; note = Related to NZ_LGTQ01000015.1; note = Jiulongibacter sediminis
cttttagcattaaagtagccattaatagaatgacgtttcgtctttctggtctcaacttacatttatacaataaacttagattttgaaaacgttagagttttcaaaactaactttatctaagtaaaag

SEQ ID NO: 16517 - RNA, 146 nt, unidentified
  source 1..146: mol_type = other RNA; note = Related to NZ_CP047218.1; note = Sphingobium yanoikuyae
accttaaactctgggtgagcaatcacctgcgggattagcttcggttaatcctcccacttgtcggcagggtgacggccccccccggggggaccgcccggcatccccgataaggcgcgtcccggtggacgggacgcgaagagttaggg

SEQ ID NO: 16518 - RNA, 130 nt, unidentified
  source 1..130: mol_type = other RNA; note = Alphaproteobacteria bacterium; note = Related to SDYH01000014.1
accttaacctctgggtgagtaatcacctgcgggattggctttcgttaatcctcttacttgtcggcagggtgacggtccccggcatccccgataaggcgcgtcccggtggacgggacgcgaagagttaggg

SEQ ID NO: 16519 - RNA, 144 nt, unidentified
  source 1..144: mol_type = other RNA; note = Related to NZ_JACIJI010000005.1; note = Stakelama sediminis
cacttaacctctgggtgagaaatcgcctgcgggatcaccttcggggggtcctcacacttgtcggcaggaagaggggacccgcaccgggaccaccaccgccaccgataaggcgcgtccgtgtggaccggacgcgaagggttgggg

SEQ ID NO: 16520 - RNA, 146 nt, unidentified
  source 1..146: mol_type = other RNA; note = Related to JACYUG010000012.1; note = Sphingomonas sp.
cacttaacctctgggtgagcaatcacctgcgggacctgctccggccggtcctcctacttgtcggctcgtgtggaggcaccccgcccggggaccgccgtcgccaccgataaggcgcgcccgtgtggagcgggcgcgaagggttaggg

SEQ ID NO: 16521 - RNA, 139 nt, unidentified
  source 1..139: mol_type = other RNA; note = Related to NZ_CP050137.1; note = Sphingomonas sp.
ccactgaactctgggtgagtaatcacctgcggggtctgcttcggctgatcctcacacttgtcaggagcttgagggccccccgcgaggggaccgccgacggcaccgataaggcgcgtccgtgtggaccggacgcgaaggg

SEQ ID NO: 16522 - RNA, 146 nt, unidentified
  source 1..146: mol_type = other RNA; note = Related to FNWK01000001.1; note = Sphingopyxis sp.
accttaaactctggatgagcaatcatccgcgggatcggtttcggcagatcctcccacttatcggcaaagtgagggcaccgcacgcgcgggaccaccgccaccaccgataaggcgcgttcgggtggaccggacgcgaagggttaggg

SEQ ID NO: 16523 - RNA, 130 nt, unidentified
  source 1..130: mol_type = other RNA; note = Related to JAERLA010000016.1; note = Acetobacter thailandicus
accttaaactcggggtgagtaatcacctgtggaaccaacttcggtaggttctctcattagtcggccgcatggagagcaccacgatcgtcgataaggcgcgtcctggtggagcggacgcgaagagttaggg

SEQ ID NO: 16524 - RNA, 141 nt, unidentified
  source 1..141: mol_type = other RNA; note = Related to QRDP01000004.1; note = Parasphingopyxis lamellibrachiae
ccgctcaacctcggggggagaaatcccctgtgggatcctcgtgatcctcatacttatcggcagaagtaggggctcccttctcgggaacgtcccgcgacaccgataagggcgcccggtgcggccgggcgcgaaggttctggg

SEQ ID NO: 16525 - RNA, 136 nt, unidentified
  source 1..136: mol_type = other RNA; note = Related to NZ_FOJU01000001.1; note = Poseidonocella pacifica
gcgccacaggctgaccggttttccggtcgaggaggcttcggcctctacccactttgggggcggcggcgatcgcgagcgacagatgcgatcggcgacgacttccgacttaaggccgcagcgcacgttgcggcacggg

SEQ ID NO: 16526 - RNA, 145 nt, unidentified
  source 1..145: mol_type = other RNA; note = Related to JAGQDF010000002.1; note = Ideonella sp.
tcgactgttggggtgctacagcaccctgtggggccgaaaggctctaactactcgcaagcccacgccgcacggtgccggtcctccggtgcgcggtacggttggggccggtgcgagcctgcccgggcgaccccgggcaggcatctgg

SEQ ID NO: 16527 - RNA, 146 nt, unidentified
  source 1..146: mol_type = other RNA; note = Related to NZ_CADEWJ010000013.1; note = Burkholderia gladioli
tcgtgtcagtggggtgtaaagcaccctgtgggaccgaaaggtcctgtcttttgctaggccgcgtgccgtggagccgagtatctgaacggaccatggcaacgtagctgatgcgagcatgcccgggacgacaccgggcatgcattggg

SEQ ID NO: 16528 - RNA, 166 nt, unidentified
  source 1..166: mol_type = other RNA; note = Related to NZ_CP091716.1; note = Variovorax paradoxus
aagtcaaaaacggagtcatggaaacgtggctcgtggaaatcgaaagatttctgacatctgctgggcacgccgcgcttacttggatctctctttcaagaagagccagccttgtgagcttgtcgtgcctaggcagcacgcttcatacgagtctgaagcgacactggcg

SEQ ID NO: 16529 - RNA, 204 nt, unidentified
  source 1..204: mol_type = other RNA; note = Related to NZ_KB905036.1; note = Variovorax paradoxus
ttgtcaaaaacggagcggcggcaacgttgctcgtgggaatcggaagattcctgacttctgcccagcacgcggttcctaatgcaccggcgcccggagatgcttacgacagcaatgccgttcgcataatcgtgttgcttagtacgaggtcctgcgtgtctgtgtagcgcagacggttccagacgagctggaaccgttttaatggcc

SEQ ID NO: 16530 - RNA, 178 nt, unidentified
  source 1..178: mol_type = other RNA; note = Related to JAGPDY010000016.1; note = Rhodoferax sp.
tcgtgaaaagtgggatgacggtaacgtcatccgtgggggctgaaaggcttctaacttctgcctggcacgtaacgcgacgcaactttgcaccacgacgacaatgacggcgtgattcggttggtagcaatgcgtggctgagcagcgaaacaggtcctggacgagccaggacctgtttaat

SEQ ID NO: 16531 - RNA, 142 nt, unidentified
  source 1..142: mol_type = other RNA; note = Related to NZ_NIAZ01000004.1; note = Acidovorax sp.
tcgttaatcgtggggatgtgggaacgcatctcgcggggccgaaaggctctgatgttctctgcggtcacgcggtcgccggtacgcggtggtccgggtggttgcagcgaagccggtcccggacgagtaccgggaccggttaggg

SEQ ID NO: 16532 - RNA, 133 nt, unidentified
  source 1..133: mol_type = other RNA; note = Gammaproteobacteria bacterium; note = Related to JAHJNJ010000041.1
tcgttaaaagcggggcatgaaagtgctcgtggcagtcgcaaggctgctaatgttcacgcaggcacgcggtcggtcgcatatgacggtgtatgccgtgaagccggtcccgaacgagattcgggaccgtttgaga

SEQ ID NO: 16533 - RNA, 143 nt, Pseudomonas sp.
  source 1..143: mol_type = other RNA; note = Related to NZ_QJUP01000005.1; note = Pseudomonas kirkiae
tcgtcaagcgaggggcgcgtaagcgctcgtggcggccgaaaggctgctgatgttcaccgcgggcatggcactggtcgggttggtccggtcgggtcgatcctgcggcgaagccggtcccggacgagttccgggaccggttgaga

SEQ ID NO: 16534 - RNA, 152 nt, unidentified
  source 1..152: mol_type = other RNA; note = Related to CP077683.1; note = Geomonas subterranea
ccttagaatactgggggtattgccccccgaggaggattaagtaagccctctgccttttcctgcggccatgcatggcacccggatgtcagtcggatgaccctgagtggttgatgggagagcctcttcgcggcgacgcgaagaggcaaatagta

SEQ ID NO: 16535 - RNA, 117 nt, Aeromonas hydrophila
  source 1..117: mol_type = other RNA; note = Related to NZ_NKXI01000009.1
aagcttaaaataggagcgaaagctctgtggagtgtaagtgctctaacagatccggtgaggcggccacgcgaactgtcgccacggcgcccggatcgccccgctgtgagcggggcaggt

SEQ ID NO: 16536 - RNA, 118 nt, Aeromonas sp.
  source 1..118: mol_type = other RNA; note = Related to CP043321.1; note = Aeromonas jandaei
aagctaaagataggagcgaaagctctgtggagtgcaatgtgctctgactgatccggtgaggcgcccacgcgaactgtcgccacggcgcccggatcgccccgctgtgagcggggcaggt

SEQ ID NO: 16537 - RNA, 118 nt, Vibrio sp.
  source 1..118: mol_type = other RNA; note = Related to AAXMMD010000082.1; note = Vibrio cholerae
aagcttaaaattaaggtaataccttgcggagtttaaaaaactctaactgatccggtgaggcgactgcgcctattctcgccactggcgcccggatcgccacgctgtgagcgtggcaggt

SEQ ID NO: 16538 - RNA, 116 nt, unidentified
  source 1..116: mol_type = other RNA; note = Related to NZ_CP074587.1; note = Pseudoalteromonas piscicida
aagcttaaaattaaggtaataccttgcggagtgtaaactctaactgatccggtgaggcggctgcgcctattctcgcctctgggcgcccggatcgccacgctgtgagcgtggcaggt

SEQ ID NO: 16539 - RNA, 139 nt, unidentified
  source 1..139: mol_type = other RNA; note = Rhodospirillaceae bacterium; note = Related to VXNK01000080.1
tcgtctgaaactggggccgaatggccctgcgggagcgtgtctcccaccactgtctcggcacacgccatcccggtcacccggtcacgcgcgccgagtggagccgccaagcacgaggcagccttggcggctagggtacggg

SEQ ID NO: 16540 - RNA, 135 nt, Pseudomonas sp.
  source 1..135: mol_type = other RNA; note = Related to JAKMVT010000021.1; note = Pseudomonas syringae
tcgcagatgtgggggcttcggccctgtggaggttcgcctctaacccttccccacgcgcgccgaggcctcagcaccactggccaccgggccgcgaagggatactgcttccgcgcgagacggaagcaggtgctcaga

SEQ ID NO: 16541 - RNA, 135 nt, Pseudomonas sp.
  source 1..135: mol_type = other RNA; note = Related to NZ_CP056030.1
tcgcagctgtgggggcttcggccctgtggaggttcgcctctaacccttccccacgcgcgccgaggcctcagcaccactggccaccgggccgcgaagggatactgcttccgcgcgagacggaagcaggtgctcaga

SEQ ID NO: 16542 - RNA, 141 nt, Pseudomonas sp.
  source 1..141: mol_type = other RNA; note = Related to FNSP01000003.1; note = Pseudomonas marginalis
tcgcagatgtgggggcctcggccctgtggaggttcgcctctaacccttccccacgcgctccggagcctcagcaccactggccactggccacgggccgcgaagggatactgcttccgcgcgagacggaagcaggtgctcaga

SEQ ID NO: 16543 - RNA, 135 nt, Pseudomonas sp.
  source 1..135: mol_type = other RNA; note = Related to JAEKFB010000009.1
tcgtagatgtgggggcttcggccctgtggaggttgaacctctgacccttccccacgcgctccgaagcctcagcgtcacaggtctcgggtcgcgaagggatactgcttccgcgcgagccggaagcaggtgctcaga

SEQ ID NO: 16544 - RNA, 134 nt, Pseudomonas sp.
  source 1..134: mol_type = other RNA; note = Related to NZ_UWFM01000116.1; note = Pseudomonas viridiflava
tcgtagatgtgggggcttcggccctgtggaggtttacctctaacccttccccacgcgctccggagcctcagcatcacaggtctcgggtcgcaacgggatactgcttccgcgcgagccggaagcaggtgctcaga

SEQ ID NO: 16545 - RNA, 134 nt, Pseudomonas sp.
  source 1..134: mol_type = other RNA; note = Related to JAAQYG010000033.1; note = Pseudomonas lundensis
tcgctgttgttggggccttggccccgtggaggcttgcctctaaccccttccccacgcgattcggcacccggcagtacgcggatccggatatgcagggatactgcttccgtgcgagtcggaagcaggtgctcaga

SEQ ID NO: 16546 - RNA, 134 nt, Pseudomonas sp.
  source 1..134: mol_type = other RNA; note = Related to NZ_JACVZE010000010.1; note = Pseudomonas pisciculturae
tcgctgttgtgagggcttcggtccagtggaggcttgcctctaaaccctttcccaagcgcttcggcacccggcagcacagggatccggagacgtggggatactgcttccgtgcgagtcggaagcaggtgctcaga

SEQ ID NO: 16547 - RNA, 139 nt, Pseudomonas sp.
  source 1..139: mol_type = other RNA; note = Related to NZ_LUUE01000002.1; note = Pseudomonas protegens
tcgcttgttgtgagggcttcggcctagtggaggcttgcctctaatccttccccacgcagttcgcccgcccgtccgtgatgccgggagcgcgatatgccgggatactgattccgtgcgagacggaatcaggtgattcaga

SEQ ID NO: 16548 - RNA, 115 nt, unidentified
  source 1..115: mol_type = other RNA; note = Related to CP008911.1; note = Burkholderia pseudomallei
tctcgtgttgttggggcgcgagccctgtggggaggaaactctctaacgtttgcccgttcaagtccttctggacgcgtcgggataggcgggttccgcgagaacggaacccggtgag

SEQ ID NO: 16549 - RNA, 119 nt, unidentified
  source 1..119: mol_type = other RNA; note = Related to NZ_LOVC01000028.1; note = Burkholderia ubonensis
tcgtgttggttggggcgatagccccgtggaggggaaactctctaacgtatgcctcgccttgaagtctgtgaaacggtggggatgggggttccggcgagaccggaacccgttgaaatagg

SEQ ID NO: 16550 - RNA, 132 nt, unidentified
  source 1..132: mol_type = other RNA; note = Related to NQMK01000010.1; note = Pusillimonas sp.
tcgcggttgtgagggcttcggccctgtggagacttaggtctctgtccattcccgcgtctgtcggctgtcgacgacactgcacgggccaggggatagccgttttcggcgagaggccgaaaacgggtgatttgg

SEQ ID NO: 16551 - RNA, 151 nt, Achromobacter sp.
  source 1..151: mol_type = other RNA; note = Related to CADIJU010000003.1; note = Achromobacter marplatensis
tcgcggttgtgggggtttcggccccgtggaggcttcggcttctgcccattcccgcgtctggcagctggcggtgctccgtcatggatgacgacatgctgcagaggcgaggggataagccgttttcggcgagaaccgaaaacgggtgattagg

SEQ ID NO: 16552 - RNA, 147 nt, Achromobacter sp.
  source 1..147: mol_type = other RNA; note = Related to CADIKQ010000001.1; note = Achromobacter mucicolens
tcgtggttgtaggggctccagccccgtggagactttggtctctgctcattcccgtctcgatctgctccagcgccgctccttcacggacgacgactggggcatggggggatagccgttttcggcgagagccgaaaacgggtgatttgg

SEQ ID NO: 16553 - RNA, 162 nt, Alcaligenes faecalis
  source 1..162: mol_type = other RNA; note = Related to MSZO01000007.1
tcgcagtagtgggggcttcggccccgcggagattcgtctctaccctttctcttgccaggcttcggtctgcgccctgctgcagtgatgtagtcagtgacgcgtgacacgcagttctccaggggataagccgttctcaacgagatgtgagaacggatgatatgg

SEQ ID NO: 16554 - RNA, 145 nt, unidentified
  source 1..145: mol_type = other RNA; note = Related to CP062062.1; note = Janthinobacterium sp.
ttgctgttttgagagcttcggctctgtggaggcttgcctctaacacttccataacctcgaaccgcggtctttcaacacgaacgactacgacacgggactggggggaaagtctgcttctggcgagagccagaagcagttgataggt

SEQ ID NO: 16555 - RNA, 151 nt, unidentified
  source 1..151: mol_type = other RNA; note = Related to RDZZ01000077.1; note = Polaromonas sp.
tcgcgatttggggacttagcaataagttctgtggaagcgaaagcttctaacctctccccagcagcaggttggcggcacggcttcacggtcgatgttcttcatgcagtgcggggatagtccggtttggcgagaaccaaaccggtgttttagg

SEQ ID NO: 16556 - RNA, 115 nt, unidentified
  source 1..115: mol_type = other RNA; note = Related to NZ_JQKD01000066.1; note = Xenophilus azovorans
tcgcgattggtggagtgaaagctccgtggaggcgcaagcttctaatccgtcccatgcgtgtctttccggttgcaggggataggcgcgtcggcgagagcccgacgcgttaatcgag

SEQ ID NO: 16557 - RNA, 147 nt, Achromobacter sp.
  source 1..147: mol_type = other RNA; note = Related to CADIJW010000048.1; note = Achromobacter dolens
tcgtagcatcgggggcttcggtcccgcgggggtgtcaaagcccctacccaatcccagaccagacggacggacgcggcctcaccgccacgactctccggcaggcaggggatagccgagtccggacgagaaccggactcgggtaactgg

SEQ ID NO: 16558 - RNA, 144 nt, unidentified
  source 1..144: mol_type = other RNA; note = Related to JAECRL010000003.1; note = Burkholderiales bacterium
tcgtagcaatggaggcttaggcctcgtgggggcgaaagctcctatccaatcccagaccagacgggtgggcacgggctctcgggcacgtctctccggcaggcaggggataaccgagtccgacgagagccggactcgggtaacagg

SEQ ID NO: 16559 - RNA, 122 nt, unidentified
  source 1..122: mol_type = other RNA; note = Related to NZ_JABBFW010000053.1; note = Azohydromonas caseinilytica
tcgcagtagttggagcttcgtctccgcggaggttgatagcctctaccacttctcctaaggtccggcccggcccggcccacggggatagtcggatccgacgagaggcggatccgtgtaaagag

SEQ ID NO: 16560 - RNA, 144 nt, Pseudomonas sp.
  source 1..144: mol_type = other RNA; note = Related to NZ_MLEM01000008.1; note = Pseudomonas syringae
tcgattgcttgtaggtgctacagcactgcggaggttgattttttggacctctaacttttggaccgggcgtgtgcggtcgtcaccgtatgcgtatgtagtgcggtcttgtaggcttcgtcgagacgtcgaagcctggtgatttca

SEQ ID NO: 16561 - RNA, 142 nt, Pseudomonas fluorescens
  source 1..142: mol_type = other RNA; note = Related to JAEKIK010000020.1
tcgattgcttgtaggtgctacggcactgcgggggttgattttggacctctaacttttgggccgggcgtgtgcggtcgtcaccgtgcgcgtatgtggtgcggtcttgtaggcttcgtcgagacgtcgaagcctggtgatttca

SEQ ID NO: 16562 - RNA, 142 nt, Pseudomonas sp.
  source 1..142: mol_type = other RNA; note = Related to NZ_CP018420.1; note = Pseudomonas veronii
tcgattgtttgtaggtgctaaggcactgtgggggttgattttgaacctctaaattttgggccgggcgtgtgcggtcgctaccgtgcgcgtatgtggtgcggtcttgtaggcttcgtcgagacgtcgaagcctggtgatttca

SEQ ID NO: 16563 - RNA, 140 nt, Pseudomonas sp.
  source 1..140: mol_type = other RNA; note = Related to CP004061.1; note = Pseudomonas aeruginosa
tcgattgctgttggtgctccggcaccgtggaggcttcggtctctaaattttggcaccgacgcgcccatcgcagtccatcgcgggtcacggccgtccagcctagtcggcatcgtcgagagcgacgatgcctggtggtttca

SEQ ID NO: 16564 - RNA, 132 nt, Pseudomonas sp.
  source 1..132: mol_type = other RNA; note = Related to LN831024.1; note = Pseudomonas aeruginosa
tcgattgctgttggtgcttcgacaccgtggaggccttgagtctctaatttttggccccgacgtggcgcgtggtatcgcgtgtgtcatcggatcggcctagtcaggcttcgtcgagagcacgaagccaggtgg

SEQ ID NO: 16565 - RNA, 140 nt, Pseudomonas fluorescens
  source 1..140: mol_type = other RNA; note = Related to CP031450.1
tcgattgttgttggtgcatagcaccgtggaggctttagcctctaacccttgggcggcacactcggcgtacgtcgtgatctacgcgtatcaccggtgcgtaccgacctagtcaggcttcgtcgagactcgaagccaggtga

SEQ ID NO: 16566 - RNA, 147 nt, Pseudomonas sp.
  source 1..147: mol_type = other RNA; note = Related to JAIZEG010000001.1; note = Pseudomonas aeruginosa
tcgattgttgttagcgtgaaaacgctgtggggatttcggtccctgacccttgggcccggcgtgcggcgaggcgtagcgatctgcgcatccatccggcgtcacggcatagtcaggcgtcgtcgagaaacacgacgcctggcgatttca

SEQ ID NO: 16567 - RNA, 142 nt, unidentified
  source 1..142: mol_type = other RNA; note = Related to NZ_BDMN01000231.1
tcgaagcaattagagtctttagctctgcggaggcaatgcctctaaaccatttttcgtgcaacattcaggtcgatacccttgtggtaatccatcactagcatgagatagccgctttcggcgagaccgaaagcgggtaattcag

SEQ ID NO: 16568 - RNA, 141 nt, unidentified
  source 1..141: mol_type = other RNA; note = Related to NZ_BLYC01000085.1
tcgaggctattagagcattagctctgtggagacactgtctctgaccatttttcgtgcaacattcaggtcgatacccttgaatgtcatccatcaccagcatgagatagccgctttcggcgagaccgaaagcgggtgattcag

SEQ ID NO: 16569 - RNA, 143 nt, Pseudomonas sp.
  source 1..143: mol_type = other RNA; note = Related to JAJHPU010000021.1
tcgttgctgttagtgcattgcactgtggagacccctggtctctgtcccttggtcgcacagagggccgcgtgcgtcgcgttatgcatgtacgccacctcgcgacataagcggcttcgtcgagagacgaagccggtgtcttcgga

SEQ ID NO: 16570 - RNA, 124 nt, unidentified
  source 1..124: mol_type = other RNA; note = Related to SCRP01000034.1; note = Paraburkholderia sp.
tcgttgctgttgaggcttcgcctcgtggaggggtaactctctaacacgtcccttcgcttcgcctctggcgaacgatatgaggggatagctgcttccggcgagagccggaagcaggtgactagga

SEQ ID NO: 16571 - RNA, 135 nt, Pseudomonas sp.
  source 1..135: mol_type = other RNA; note = Related to JACYWI010000012.1; note = Pseudomonas syringae
ttgatagtgtttggcagcacttgtggctgtcgtggaggatttataccctctgttccccgtgcctgcgcggatcggtgccctcgggctaccacgttcccgtcagggctgtgcgtcgtcgagagcgacgcacagtgg

SEQ ID NO: 16572 - RNA, 135 nt, Pseudomonas sp.
  source 1..135: mol_type = other RNA; note = Related to CP045551.1; note = Pseudomonas putida
tcgattgtgtttggcagctcttgtggctgtcgtggaggagttaaatcctctgtcccccgtgcctgcgcggatcggtaccctcgggttaccaagttcccgtcagggctgtgcgtcgtcgagagcgacgcacagtgg

SEQ ID NO: 16573 - RNA, 141 nt, Pseudomonas sp.
  source 1..141: mol_type = other RNA; note = Related to WIVT01000008.1; note = Pseudomonas helleri
ttgagtgtatttggtggacgtgagtctatcgtggaggtatcaacctctaaccccatgcctgcacgcatccggtccctcgtgggtatcccgggtggctgccagggctgtgcgtcgttgagacgcgacgcacagtggctctta

SEQ ID NO: 16574 - RNA, 120 nt, unidentified
  source 1..120: mol_type = other RNA; note = Related to JACXXJ020000005.1; note = Agrobacterium vitis
ccgtctatgtgtggggccggaggccctgtggggatgtaaatccccgattcaatcctgcgtctggctagggaccgcggcacgcgcgccgcacccggcgggctcgggtgcggcatgttcgag

SEQ ID NO: 16575 - RNA, 118 nt, unidentified
  source 1..118: mol_type = other RNA; note = Related to CP081837.1; note = Agrobacterium vitis
ccgtcaatgtgtggggccggaggccctgtggggatgcaagtccccgattcaatcccgtgtctggcagggaccgtggccgcgcgccgcacccgtcgggcccgggtgcggcatgttcgag

SEQ ID NO: 16576 - RNA, 119 nt, unidentified
  source 1..119: mol_type = other RNA; note = Related to JAAMDS010000038.1; note = Agrobacterium rhizogenes
ccgtcaatatgtggggccggaggccctgtggggatgaaaatccccgactcaatcccgtcgtctgctggggaccgtggccgcgcgccgcacccgtcgggcccgggtgcggcatgttcgag

SEQ ID NO: 16577 - RNA, 117 nt, unidentified
  source 1..117: mol_type = other RNA; note = Related to NZ_NNRJ01000027.1; note = Brucella thiophenivorans
ccgtctatatgtggggccggaggccctgtggggattagtccccgtctcaatcctgcgtctgccgggacccgtggcctcgcgccgcacccgtcgggcaccaggtgcggcatattcgag

SEQ ID NO: 16578 - RNA, 122 nt, unidentified
  source 1..122: mol_type = other RNA; note = Related to NZ_PVWU01000025.1; note = Rhizobium pusense
ccgtcgatgtgtggggccggaggccgtgtggagacctggtaggtctccgactcaatcccgtcgtctggcaggggccgtggccgcgcgccgcaccctccgggctcgggtgcggcatattcgag

SEQ ID NO: 16579 - RNA, 121 nt, unidentified
  source 1..121: mol_type = other RNA; note = Related to JACDJD010000002.1; note = Rhizobium leguminosarum
ccgtcgatgtgtggggccgatggccctgtgggggtgtttacatccccgattcaatcccgtctctggcagggaccgtggcccgcgcgccgcaccctccgggctcgggtgcggcatattcgag

SEQ ID NO: 16580 - RNA, 119 nt, unidentified
  source 1..119: mol_type = other RNA; note = Related to FZNM01000001.1; note = Paracoccus sediminis
ccgtcttgagttggggccgtgagccctgtggaggccgatggtctccgtctcaatcccgtagctggcagggaccgcggacgagcgccgcacccgctgggcacgggtgcggcatgttcgag

SEQ ID NO: 16581 - RNA, 120 nt, unidentified
  source 1..120: mol_type = other RNA; note = Related to JASG01000004.1; note = Sulfitobacter guttiformis
ccgtctggagttggggccatgagccctgtggagaccaatggtctccgtctcaatcccgttcgtcggcagggaccgcggcagcgcgccgcacccgctgggctcgggtgcggcatgttcgag

SEQ ID NO: 16582 - RNA, 120 nt, unidentified
  source 1..120: mol_type = other RNA; note = Related to NZ_SPUW01000001.1; note = Pseudooceanicola onchidii
ccgtcttgagttggggccttgagccctgtggagaccgatggtctccgattcaatcccgtttaccggcagggaccgcagccgcgcgccgcacccgctgggcacgggtgcggcatgttcgag

SEQ ID NO: 16583 - RNA, 120 nt, unidentified
  source 1..120: mol_type = other RNA; note = Related to NZ_QRBG01000022.1; note = Cereibacter sphaeroides
ccgtcttgagttggggccgtgagccctgtggaggcgtcaagcctccgttccactcccgagccggcagggaccgcggccacggcgccgcacccgcccgggtccgggtgcggcatgttcgag

SEQ ID NO: 16584 - RNA, 116 nt, unidentified
  source 1..116: mol_type = other RNA; note = Related to NZ_APLP01000010.1; note = Agrobacterium tumefaciens
gtccaatgtgttggggcttcggccctgtggaggcctcaaaacctccgtctcactcccaggtctggcggggggcgcgcgcgtccgcacccgtcgggcccgggtgcggcatattcgag

SEQ ID NO: 16585 - RNA, 118 nt, unidentified
  source 1..118: mol_type = other RNA; note = Related to NZ_AP023278.1; note = Agrobacterium vitis
ccgtccgatgtgtggggccgtaggccctgtggaggccttaaacctccgtctcactcccgtgtctggctggggggcgcgcgcgtccgcacccgtcgggcccgggtgcggcatattcgag

SEQ ID NO: 16586 - RNA, 120 nt, unidentified
  source 1..120: mol_type = other RNA; note = Related to CP033022.1; note = Agrobacterium sp.
ccatcaatatgtggggccacagagccctgtgggggcgcaagcctccaattcacttccgatggctggaaggggacggcagcgcgccgcacccggtagggcttcgggtgcggcatatcgagg

SEQ ID NO: 16587 - RNA, 119 nt, unidentified
  source 1..119: mol_type = other RNA; note = Related to CCRK01000005.1; note = Neorhizobium galegae
ccatcaatatgtggggccttagagccctgtggaggtgcaaacctccaattcacttccgacggctggaaggggacggcacgcgccgcacccggtagggcttcgggtgcggcatatcgagg

SEQ ID NO: 16588 - RNA, 120 nt, unidentified
  source 1..120: mol_type = other RNA; note = Related to NZ_AP025032.1; note = Aureimonas sp.
ccgtctaaatgtggggcctggagccctgtgggaacgcagtgttcccgtttcaatcccgtgtctggcagggaccgtggccgcgcgccgcacccgtcgggctccgggtgcggcatattcgag

SEQ ID NO: 16589 - RNA, 119 nt, unidentified
  source 1..119: mol_type = other RNA; note = Related to MEEU01000016.1; note = Pelagibacterium sp.
ccgtcgaagtgtggggcctggtgccctgtgggagcctagtgttcccgtctcaatcccgtgtctggcagggaccgtggcgcgcgccgcacccgtcgggctccgggtgcggcatattcgag

SEQ ID NO: 16590 - RNA, 121 nt, unidentified
  source 1..121: mol_type = other RNA; note = Related to JADCRT010000002.1; note = Methylobacterium mesophilicum
ccgtcgatgtgttggggccggaggccctgtggggatcttcggattcccgattcaatcccgtctctggctgggaccgcggcacgtgccgcacccgccgggcaacgggtgcggcatgttcgag

SEQ ID NO: 16591 - RNA, 122 nt, unidentified
  source 1..122: mol_type = other RNA; note = Related to VFMG01000001.1; note = Bosea sp.
ccgtcgaagtgttggggcctggagccctgtgggagctttatgctcccgtctcagatccggcgtctggatgggaccgtggccgcgcgccgcacccgccgggcttcgggtgcggcatattcgag

SEQ ID NO: 16592 - RNA, 118 nt, unidentified
  source 1..118: mol_type = other RNA; note = Related to JACEMU010000004.1; note = Paracoccus sp.
ccgacaaaggctggggccggaggccctgtgaaggcttagcgccttcgactcgttcctgcgtctctggctggaccgtggcagcgcgccgcgcccgcccggggccgggcgcggcatgtaa

SEQ ID NO: 16593 - RNA, 116 nt, unidentified
  source 1..116: mol_type = other RNA; note = Related to NZ_WQCG01000003.1; note = Ruegeria atlantica
ccgacaaaggctggggccagaggccctgtgaaggcttagagccttcgtctagttcctgtgtctctggatggaccgtggcagcgcgccgcgcccgcccgggaccgggcgcggcatgg

SEQ ID NO: 16594 - RNA, 118 nt, unidentified
  source 1..118: mol_type = other RNA; note = Related to CP002623.1; note = Roseobacter litoralis
ccgacgagaactggggccagaggccctgtgaaggcttagagccttcgtctctcacctgcgtctcggcacgggggatggccgcgcgccgcaccccaccggggttgggtgcggcatgtaa

SEQ ID NO: 16595 - RNA, 118 nt, unidentified
  source 1..118: mol_type = other RNA; note = Related to NZ_CP045393.1; note = Roseovarius sp.
ccgacgagaactggggccagaggccctgtgaaggcttagcgccttcgactctcacctgcgtctcgggatgcggggtggccgccggccgcacccatccgggattgggtgcggcatgtaa

SEQ ID NO: 16596 - RNA, 117 nt, unidentified
  source 1..117: mol_type = other RNA; note = Related to CP059262.1; note = Exiguobacterium profundum
ccgacgcgaactggggccagtggccctgcgaggccaagagccttcgactcacacctgcgtctcggggtgggggctggccgcgcgccgcacccatccggggttgggtgcggcatgtaa

SEQ ID NO: 16597 - RNA, 120 nt, unidentified
  source 1..120: mol_type = other RNA; note = Related to JACESO010000004.1; note = Sphingobium sp.
ccgtcgaagtgtggggcctggagccctgaggaggcatattgcttccgatatcaatctcgtggctggtcgggaccgtggcgtgcgccgcacccgtcgggctccgggtgcggcatgttcgag

SEQ ID NO: 16598 - RNA, 119 nt, unidentified
  source 1..119: mol_type = other RNA; note = Related to FOFL01000001.1; note = Devosia sp.
ccgtctaagtgtggggcctagagccctgtggaagcttcggcttccgtcaacctcgtcgtctctcagggccgtggcgcgcgcgccgcacccgtccgggcgccgggtgcggcatattcgag

SEQ ID NO: 16599 - RNA, 122 nt, unidentified
  source 1..122: mol_type = other RNA; note = Related to NZ_FPKU01000001.1; note = Devosia enhydra
ccgtctatcgttggggcctctggccctgtggaggcgtgaaagcctccaattcaatcccgacgaccggtagggagcgaggccgcgcgccgcacccgcccgggatcgggtgcggcaaattcgag

SEQ ID NO: 16600 - RNA, 116 nt, unidentified
  source 1..116: mol_type = other RNA; note = Related to WRPF01000034.1; note = Caulobacteraceae bacterium
acgcatactggggccttgagccctgtgagaagcttagcttctcgaccaccgtccgcgtgtgcagggatgtcggtgcctcggtgccgcgccctcaggccgggcgcggcctattaggg

SEQ ID NO: 16601 - RNA, 119 nt, unidentified
  source 1..119: mol_type = other RNA; note = Related to NZ_LMNU01000047.1; note = Methylobacterium sp.
tcgtcaccagctggggcttcgagccctgtgagaggttaatcctctcgtctacctccttcggcctcagcgggggcggcgccgtgccgcgcccgcccggggccgggcgcggcaatcccgag

SEQ ID NO: 16602 - RNA, 119 nt, unidentified
  source 1..119: mol_type = other RNA; note = Related to CP021181.1; note = Rhizorhabdus wittichii
ccgtcagcagcaggggccacaagccctgtgggaagattgtcttcccgactaccacctgcgtctcggccgggagtggcgctgcgccgcgcccgcccgggaccgggcgcggcaaccccgag

SEQ ID NO: 16603 - RNA, 114 nt, unidentified
  source 1..114: mol_type = other RNA; note = Related to NZ_LDTE01000007.1; note = Sphingomonas sanguinis
ccgtcagaagctggggccaaaagccctgtaaggagaaatccttgactacttcctgtgtctcggcgggggagcggcgcgccgcgcccgcccgggaccgggcgcggcgaccccgag

SEQ ID NO: 16604 - RNA, 119 nt, unidentified
  source 1..119: mol_type = other RNA; note = Related to NZ_AP017898.1; note = Sphingopyxis sp.
ccgtcagaagctggggcctatggccctgtggggagattgtttccccgactaccacctgcgtctcggccgggggtggcgtcgcgccgcgcccgcccgggaccgggcgcggcaaacccgag

SEQ ID NO: 16605 - RNA, 119 nt, unidentified
  source 1..119: mol_type = other RNA; note = Proposed Citromicrobium sp.; note = Related to CP011344.1
ccgtcagaagctggggcctttggccctgtggggagattttctccccgactaccacctgcgtctcggccgggggtggcgtcgcgccgcgcccgcccgggaccgggcgcggcaaccccgag

SEQ ID NO: 16606 - RNA, 116 nt, unidentified
  source 1..116: mol_type = other RNA; note = Related to JAGHQS010000004.1; note = Qipengyuania flava
ccgtcagaagctggggccgctggccctgtggggagattggctccccgactaccacctgcgtctgggcggggtgcggtgcgccgcgcccgcccgggaccgggcgcggcatgcccgag

SEQ ID NO: 16607 - RNA, 119 nt, unidentified
  source 1..119: mol_type = other RNA; note = Related to JADOUC010000001.1; note = Sphingobium sp.
ccgtcagaagctggggccacaagccctgtggggagattgcctccccgactaccacctgcgtctcggcggcggggagcggcgcgccgcgcccgcccgggaccgggcgcggcaagcccgag

SEQ ID NO: 16608 - RNA, 116 nt, unidentified
  source 1..116: mol_type = other RNA; note = Related to NZ_JACBGA010000006.1; note = Sphingopyxis sp.
ccgtcagaagctggggcgaaaagccctgtggggagattgtcttcccgactaccacctgcgtctcggccgggggcggtgcgccgcgcccgcccgggaccgggcgcggcaagcccgag

SEQ ID NO: 16609 - RNA, 120 nt, unidentified
  source 1..120: mol_type = other RNA; note = Related to LMKH01000010.1; note = Sphingomonas sp.
ccgtcagaagcaggggcgatctcaagccctgtgggagaatggttctcccgactaccacctgtgtctcggcgggggggcggcgcgccgcacccgcccgggaccgggcgcggcatgcccgag

SEQ ID NO: 16610 - RNA, 116 nt, unidentified
  source 1..116: mol_type = other RNA; note = Related to JAIZSQ010000047.1; note = Burkholderia vietnamiensis
gcgtagtacctgggcctgcagtgtgaggcctgcggagaggcaactctccaatcattgccccgggccatgtgcctcgggcgccccggccgccgcctggtacggcggccggaaacgga

SEQ ID NO: 16611 - RNA, 117 nt, unidentified
  source 1..117: mol_type = other RNA; note = Related to JAGSTU010000036.1; note = Burkholderia vietnamiensis
gcgtattgcctgggccgctgcgatgggcctgcggagaggaaactctccaacctttgccccgggacgcgtgtctcgggcgcccccggccgccgcctggtacggcggccggaaaacgga

SEQ ID NO: 16612 - RNA, 107 nt, unidentified
  source 1..107: mol_type = other RNA; note = Related to NZ_JAFD01000236.1; note = Burkholderia sp.
gcgtattacctgggcctgctgtcagggcctgcggagaggaaactctccaacctttgcccggtttctgggcgcccggccgccgcctggttgcggcggccggaaacgga

SEQ ID NO: 16613 - RNA, 117 nt, unidentified
  source 1..117: mol_type = other RNA; note = Related to JACZKT010000108.1; note = Rubrivivax sp.
gcgtagtacctggacccgctgtttggggtctgcggagaggcaactctccaaccattgccccggtcacgcgtaccggggcgccccggccgccgcctggtgcggcagccgggagacgga

SEQ ID NO: 16614 - RNA, 129 nt, unidentified
  source 1..129: mol_type = other RNA; note = Related to CP001505.1; note = Burkholderia glumae
tcgtaatgctggccttagggctgtggaggggaaaccctctgacacatcgcggagcgcatggccgatgcgatcggcacggcgggacgcgatggctgtggtgccgcctggaagcggcaccacagttctagg

SEQ ID NO: 16615 - RNA, 128 nt, unidentified
  source 1..128: mol_type = other RNA; note = Related to VCIZ01000019.1; note = Cupriavidus campinensis
cagtttttgacgggcctttgggctgaggaggggaaaccctctaccacctttgcgggcgcaggaccggagacgggacgacgcattgcgaagggacgcgccgccgcctggaacggcggcgcgattcgggg

SEQ ID NO: 16616 - RNA, 118 nt, unidentified
  source 1..118: mol_type = other RNA; note = Related to NZ_MUAV01000008.1; note = Rhodovulum viride
tcctcatacccagcttggactcgttcaagcgcggaggggttttcccctctaccacttctaccgcacacggcccggaggcccccgagggggacgagaggacggcggcgggcgaagcaga

SEQ ID NO: 16617 - RNA, 118 nt, unidentified
  source 1..118: mol_type = other RNA; note = Rhodobacteraceae bacterium 9Alg 56; note = Related to CP046620.1
tcctcatacccagcttggacttgttcaagcgcggaggggttctcccctctaccacttctaccgcacacggcccggagtccccggagggggacgaggggacggcggcgggcgaagcaga

SEQ ID NO: 16618 - RNA, 124 nt, unidentified
  source 1..124: mol_type = other RNA; note = Related to NZ_RWJI01000001.1; note = Sphingorhabdus wooponensis
ttctcatattcagctttgacgttagtccgagcgtggagagcgaaagctctctgacacttcattcgcacaggccgcgatggccccggcgacggggatgcgcggacgacggcgagcgaagcagaga

SEQ ID NO: 16619 - RNA, 151 nt, unidentified
  source 1..151: mol_type = other RNA; note = Related to NZ_JAGGJV010000004.1; note = Rhizobium herbae
tcgtcattttcaggccattctcagaaatgcgaatgccgtggaggaccttcgtgtcctctgatcttacccggacgcccgaggacccgagaggggacggcggcggcgggcgaagcagaagcagtcccgacgagcgggctgcttctaggtagaa

SEQ ID NO: 16620 - RNA, 151 nt, unidentified
  source 1..151: mol_type = other RNA; note = Related to JAGIPO010000002.1; note = Agrobacterium tumefaciens
tcgtcattttcaggccattctcagcgatgagaatgccgtggagggccgctgtgtcctctgatcttacccggacgcccgaggacccgagaggggacggcggcggcgggcgaagcagaagcagccccgacgagggggctgcttctagatagaa

SEQ ID NO: 16621 - RNA, 150 nt, unidentified
  source 1..150: mol_type = other RNA; note = Related to NZ_LMPE01000005.1; note = Rhizobium sp.
tcgtcattttcaggtattcgcatatgcggataccgtggaggacctcgcgtcctctgatcttacccggacgccgggcgacccgagaggggaggccgtggcgggcgggcgaagcagaagcagccctaacgagcgggctgcttctaggtaaaa

SEQ ID NO: 16622 - RNA, 147 nt, unidentified
  source 1..147: mol_type = other RNA; note = Related to JAILYH010000012.1; note = Rhizobium sp.
tcgttattttcaggccattcgcgaaagcgaatgccgtggagggccttcgtgccctctgatcttacccggacgcccgaggagacccgagaggggacgacggcggcgggcgaagcagaagcaaccccgacgagcgggttgcttctaggt

SEQ ID NO: 16623 - RNA, 153 nt, unidentified
  source 1..153: mol_type = other RNA; note = Related to JABDWX010000001.1; note = Rhizobium bangladeshense
tcgtcattttcaggccattcgcgcaagcgagtgccgtggaggaccttcgtgtcctctgatcttacccggacgcccgaggaaggacccgagaggggacgacggcggcggtcggagcagaagcaaccccgacgagcgggttgcttctaggtagaa

SEQ ID NO: 16624 - RNA, 150 nt, unidentified
  source 1..150: mol_type = other RNA; note = Related to VIUA01000006.1; note = Rhizobium sp.
tcgtcattttcaggccattcgcgtaagcgagtgccgtggagggcctttgtgtcctctgatcttacccggccgcccgaggccccgaggaggggacgacgacggcgggcgaagcagaagcaaccccgacgagcgggttgcttctaggtagaa

SEQ ID NO: 16625 - RNA, 140 nt, unidentified
  source 1..140: mol_type = other RNA; note = Related to NZQL01000081.1; note = Hyphomicrobiales bacterium
tcgttatctgaaggtcgggctctattatcccgaccgtggaggggtgaccctctatcacttcccccaagaggccccggtgggacggggaccgacacgggcgaagcagccgcgatcaacgactgatcgcggctagaatgaag

SEQ ID NO: 16626 - RNA, 145 nt, unidentified
  source 1..145: mol_type = other RNA; note = Related to NZ_SJFN01000052.1; note = Siculibacillus lacustris
tcgtttcatccagtaccgccgcaaggcagtacgcggagagggcaacctctctaccgcttatccgccgccaccgggctctcctctgggccgggccgcgacggcgaagcaagatccgccaacgacaggcggatctttggcacttggg

SEQ ID NO: 16627 - RNA, 137 nt, unidentified
  source 1..137: mol_type = other RNA; note = Related to RXIY01000013.1; note = Hyphomicrobiales bacterium
tcgtcatatccagggccgcccatcggcggcccgcggaggaggcaactcctctatcgcttgctggtgtcgagcccggggatgggcgagggccggacggagcaagagccgctacgacgcgcggctctaaggcacttggg

SEQ ID NO: 16628 - RNA, 131 nt, unidentified
  source 1..131: mol_type = other RNA; note = Related to CP055265.1; note = Agrobacterium vitis
tcatcacaccttgaactcttcggagttcgcggaggggtagccctctactgcttatccggcccacggccccggacccccggaggacgatggcgggcgaagcgagacccaggatgaccttgggtctcttggta

SEQ ID NO: 16629 - RNA, 139 nt, unidentified
  source 1..139: mol_type = other RNA; note = Related to WGNU01000009.1; note = Alphaproteobacteria bacterium
tctttaaaccttgggcctttcggggctcgtggaaggagcgatccttctaacgcttgctgggcccacggccccggccgctcgacgaccggtccgcagaccagcgaagcagacacggcgaaagacacgccgtgtctatgca

SEQ ID NO: 16630 - RNA, 145 nt, unidentified
  source 1..145: mol_type = other RNA; note = Related to NC_016587.1; note = Azospirillum lipoferum
gcccattcgctgagtgaatctctcgattcactcgtgggagatatataaatctcctaacatcctgcacgggtggtccggcgacgcggcgacgcggcggcggccgtccgcaggcggcgcggggccggggcaccggccccgcgccggg

SEQ ID NO: 16631 - RNA, 147 nt, unidentified
  source 1..147: mol_type = other RNA; note = Related to NZ_FXAK01000010.1; note = Azospirillum oryzae
acgcccattcactgagtgaaccacatggttcactcgcgggagatgtaaaaatctcctaacatcctgcacgggtggtccggtggcgcggcaacgcggcggcggtcgtccgcaggcggcgcggggccggggcaccggccccgcgccggg

SEQ ID NO: 16632 - RNA, 142 nt, unidentified
  source 1..142: mol_type = other RNA; note = Related to NZ_CP029353.1; note = Azospirillum thermophilum
gcccattcactgagtaagtcatcggacttactcgtgggaggtgttaatgcctcctaacaaactgtggcggtggtgcggcgcggcgacgcggcgacgtccgtccgcagacggcgcggggccaggacattggccccgcgctggg

SEQ ID NO: 16633 - RNA, 123 nt, unidentified
  source 1..123: mol_type = other RNA; note = Related to JABMLM010000386.1; note = Microvirga sp.
ccatcattcactgaggctccatccggagccttgcggaaggcaaacgccttctaccattcggccggttcgtgctgagcgcgcggtccggacgggcgtgcccccgatggcgggggcacgcccgta

SEQ ID NO: 16634 - RNA, 135 nt, unidentified
  source 1..135: mol_type = other RNA; note = Related to RRYK01000010.1; note = Pseudoxanthomonas sp.
tcgcaaacggctgagtgtgatgcactcgaggggatcagatccctacgacatccggcggacgacccggcttatggccgcacgggaaacgtctatccggtcaggtggctgcggcgaaggcacgcagccaaagatgga

SEQ ID NO: 16635 - RNA, 138 nt, unidentified
  source 1..138: mol_type = other RNA; note = Related to NZ_LASZ01000005.1; note = Luteimonas sp.
tcgcaacgacgtgagtgggcaaccactcgtgggacgcaagtcccgacacattcccgaagccatcgtcccgtcatgcccgggcgatccagcgagggggtcaggtggctgcgtcgtgaggccgcagccaagtggtcagag

SEQ ID NO: 16636 - RNA, 127 nt, unidentified
  source 1..127: mol_type = other RNA; note = Related to LR990730.1; note = Xanthomonas hydrangeae
tcgcaaacagttgggccgcaaggcctgtggaggcaattgcctctaaccgctccagcccagcggcgattcggtcttccggctcgtcgacggaacggagggacgatgagcgacgcgcggcgtgaccgga

SEQ ID NO: 16637 - RNA, 174 nt, unidentified
  source 1..174: mol_type = other RNA; note = Related to NZ_CP061930.1; note = Klebsiella michiganensis
acgccatcaattgggcatttatgtccgtggaaagcttacgctttctaacatttaccccgcgcaacgcctcagggcctcgcagcgacactgctcgtaagagtcatcgctggctcagatggtatggcgtatgggtattcgaaccctttgggcgaccaagggttcgtggagcagggg

SEQ ID NO: 16638 - RNA, 157 nt, Escherichia coli
  source 1..157: mol_type = other RNA; note = Related to CP056584.1
tcgccatcaattgggtattttttacccgtggaaagttaacactttctaccgtttaccccgcgcaacgcccctgccagcgacaagagtcacaggaccaggtggtatggcgtatgggaattcgaaccctttgggcgacaaagggttcgtggagcaggga

SEQ ID NO: 16639 - RNA, 167 nt, Enterobacter sp.
  source 1..167: mol_type = other RNA; note = Related to NZ_JAIFPH010000003.1; note = Enterobacter hormaechei
tcgccatcaattgggtattgattacccgtggaaagcagatgctttctaacctttaccccgcgcaacgcccctgagcgacgcagctcgcgagagtcatcgtatgtccaggtggtatggcgtatgggtattcgaaccctttgggcgaccaagggttcgtggagcagggg

SEQ ID NO: 16640 - RNA, 157 nt, Escherichia coli
  source 1..157: mol_type = other RNA; note = Related to UGAA01000001.1
tcgccatcaattgggtatttattgcccgtggaaagctaatgctttctaacatttaccccgcgcaacgcctctgtcagcgacaggagtctctgattcaagcggtatagcgtatgggtattcgaaccctttgggcgacaaagggttcgtggagcaggga

SEQ ID NO: 16641 - RNA, 170 nt, Enterobacter sp.
  source 1..170: mol_type = other RNA; note = Related to CP074170.1
tcgccaccaattgggccttaattgcccgtggaaagcttcggctttctaaaatttaccccgcgcaacgcctctgtgcgcctgagcggctcgtgagagtcaccactggtccagatggtatcgcgtatgggtattcggaccccttgggcgaccaagggtccgtggagcagggg

SEQ ID NO: 16642 - RNA, 156 nt, Escherichia coli
  source 1..156: mol_type = other RNA; note = Related to CP023960.1
tcgccatcaattgggtaactttacccgtggaaagttaacgctttctaacatttaccccgcgcaacgcccctgccagcgacaagagtcacaggatcaggcggtatggcgtatgggtattcgaaccctttgggcgaccaagggttcgtggagcagggg

SEQ ID NO: 16643 - RNA, 172 nt, unidentified
  source 1..172: mol_type = other RNA; note = Related to NZ_WUBS01000011.1; note = Acerihabitans arboris
ccgccatcaattgggttaatagcccgaggaaagctttgtgctttctaccatttatcccgcgcaacgcccctgtcggctgtggtgtcctcggaaagctgggtcatcgtagagtaggtggtatggcgcatgggtattcgaagcattgggcgaccaatgcttcgtggagctggga

SEQ ID NO: 16644 - RNA, 154 nt, Escherichia coli
  source 1..154: mol_type = other RNA; note = Related to CP010122.1
tcgtcatcaactgagttgtaaaactcgcggaaagcttaaccgctttctacctatttacccccacgcatggctcctgacgcctccgggcagtactggcagcatagcatgatgggtattcgaaccctctgggcgacagagggttcgtggagcgggg

SEQ ID NO: 16645 - RNA, 208 nt, Vibrio sp.
  source 1..208: mol_type = other RNA; note = Related to MCYV02000002.1; note = Vibrio splendidus
ccgccacttattgaacattcgtgttcgaggaaagtttaggctttctaccatatttcccccatgcctcgctctcaacaaccctgtgccatcaggtgccttgaacagccatacggttgaacattgcaatctggataaatcagtagaattgaatagcatggacatgatgggaattcgcacttttgggcgaccaaagtgcgtggaaccgggg

SEQ ID NO: 16646 - RNA, 205 nt, Vibrio sp.
  source 1..205: mol_type = other RNA; note = Related to PIFL01000078.1; note = Vibrio splendidus
ccgccacttactgagcattcgtgctcgaggaaagtttaggctttctaacattttcccccatgcctcgctatcaaccccctgtgctatcaggcgccttggacaacttacggttgcacatcgctatctagataggtcagtagaattgaaaagcatggacatgaagggaattcgcacttttgggcgaccaaagtgcgtggaaccgggg

SEQ ID NO: 16647 - RNA, 153 nt, Vibrio sp.
  source 1..153: mol_type = other RNA; note = Related to VTLM01000009.1; note = Vibrio cholerae
acgccattaactgagatacttaggtactcgtggaaagtgtaaatactttctaacaacttcccccacatgccccgtcgctccaccgcgtgtgttgcatgacatggacatggggaattcgcgactttggggcgacccaaagtcgcgtggaacggg

SEQ ID NO: 16648 - RNA, 149 nt, unidentified
  source 1..149: mol_type = other RNA; note = Related to NZ_CP035690.1; note = Grimontia hollisae
tcgccatcaactgaacatacaatgttcgtggaaagacgaagttctttctaacattttcccccatgcctggtcgcttcatcactgatgatgcatgacatgacatgaaggaattcgcaactttggggcgacccaaagttgcgtggaacggg

SEQ ID NO: 16649 - RNA, 148 nt, unidentified
  source 1..148: mol_type = other RNA; note = Related to NZ_CP058958.1; note = Providencia rettgeri
tcgccattaattgaatatttcggtattcgcggaaagacttgtctttctacctacttcccgcatgcctagtcgcttcacggttgtgttgcatgacatgaacatgatggaattcgcaactttggggcgacccaaagttgcgtggaacggg

SEQ ID NO: 16650 - RNA, 171 nt, Vibrio sp.
  source 1..171: mol_type = other RNA; note = Related to NZ_CP054700.1; note = Vibrio alginolyticus
tcgccatcaactgagtgcaaactcgaggaaagtttcggactttctgccttttcccccgtgcgtgttcccttcgccgtcgcttgatgttcatcatcaggttgctggataagactgagaacgaaagcgcgggcgggtttcgaacctttgacgaacaaggttcgtgaaatggga

SEQ ID NO: 16651 - RNA, 144 nt, unidentified
  source 1..144: mol_type = other RNA; note = Related to NZ_LTYZ01000001.1; note = Aliivibrio fischeri
tcgccatatattgagtgtttacactcgtggaaagtttactttctgactttttcccccacatgtccgttcgtctcgcctcgcgcctgatgacatcaacatgtaaggaattcgcaatcttggcgagcaagattgcgtggaacggga

SEQ ID NO: 16652 - RNA, 145 nt, Vibrio sp.
  source 1..145: mol_type = other RNA; note = Related to NMSO01000008.1; note = Vibrio metoecus
ccgccactaactggactatgtccgaggaaagagcaatctttctacccttttacccccacatgcttggcttcgttacatcagtgacagcatgaacatgggagggtactcgaaccttttgggcgaccaaaggttcgtcgagacgggg

SEQ ID NO: 16653 - RNA, 148 nt, Vibrio sp.
  source 1..148: mol_type = other RNA; note = Related to PIFP01000042.1; note = Vibrio splendidus
tcgccatatattgagccgtaaggcttgagggaaagcctagctttctaccctattgacccgcacatgactaacagtgacctcgtgagcaccgttcggaacatgtgggaattcgaactttttgggcgaccaaaagttcgtcgagatgggg

SEQ ID NO: 16654 - RNA, 151 nt, Vibrio sp.
  source 1..151: mol_type = other RNA; note = Related to CP073273.1; note = Vibrio fluvialis
tcgtcacttattgagcttatttagctcgtgggaaaacgaaagttttctgcctttttgacccatacatgcctagcagtgaccatgatgagcaccgttcagaacatgtgggaattcgaaccttgggacgaaaccaaggttcgtcgagacgggg

SEQ ID NO: 16655 - RNA, 158 nt, unidentified
  source 1..158: mol_type = other RNA; note = Related to JADZHF010000006.1; note = Shewanella algae
tcgccaccaacttgggcttagcttttaaagtaggctcgtgggaaagcaattgctttctaccttttatacccagacatgcctgccgtagctcgatgagggacgcgcgtagaacatgtgggaactcgagccctaggcgacctgggctcgtcgaaacgggg

SEQ ID NO: 16656 - RNA, 165 nt, unidentified
  source 1..165: mol_type = other RNA; note = Related to AXZL01000070.1; note = Shewanella decolorationis
acgccataaattgaactctgctttggcagggagttcgtgggaaagcgaaagctttctgcctgttaacccagacatgcctgccgtcctaccgtcgctcgacgagagacacgcgcggtacatgtgggaactcgaaccttcgggcgaccgaggttcgtcgaaacgggg

SEQ ID NO: 16657 - RNA, 154 nt, unidentified
  source 1..154: mol_type = other RNA; note = Related to NC_006371.1; note = Photobacterium profundum
tcgccaaaaaatgagttaactttttgttactcgagggaaattttatttcctacctatttcccccatgcacgtctctttacggctacggctgcagctagacattaacatgagagggtatcgcacccagaggcgactctgggtgcgtggaacgggg

SEQ ID NO: 16658 - RNA, 153 nt, Aeromonas salmonicida
  source 1..153: mol_type = other RNA; note = Related to NZ_CP060032.1
tcgtcatgtgtttgagctatttattttgctcgcgggaaatttcggtttcctaaattctccacgcgcttcgcctgccaccggtcctggaccatggcgcggcatcaacgtgaggggactcgcgaattggggcgacccaattcgcgtggaacgggg

SEQ ID NO: 16659 - RNA, 151 nt, Aeromonas sp.
  source 1..151: mol_type = other RNA; note = Related to JAEHHN010000014.1; note = Aeromonas caviae
gcctactacatagagcgttacgctctgggagacgattgtttcctaaattctccacgcgcctgcctgtgtccccatcctcgcgatgcggtcatgcggcgatcacgtgatggggactccgcgaacaggggcgaccctgttcgcgtggaacggg

SEQ ID NO: 16660 - RNA, 180 nt, unidentified
  source 1..180: mol_type = other RNA; note = Related to LXEX01000068.1; note = Obesumbacterium proteus
cagttttacatgagtagatttacgaatttactcgcggaggattttatcctctacatagttacccccacctgatgacgttggctccgtagctaatcttatcgctgtgtaacgtagtgttgcgcatgtaagggtcgagggtattctgattgtggtggcgacaccacaatcagattgaaaagg

SEQ ID NO: 16661 - RNA, 152 nt, unidentified
  source 1..152: mol_type = other RNA; note = Related to NZ_CP031727.1; note = Cellvibrio sp.
tcgccatcgcctgagtttgatgtattggaactcgcggagagcttgctctctaccaattacccgcccaagcagcgttaggccttatacgcttatccagcatggcagcgagtacacacccgtaggggcgaatccctacgggtggaaaacaaggg

SEQ ID NO: 16662 - RNA, 157 nt, unidentified
  source 1..157: mol_type = other RNA; note = Related to NZ_CP047970.1; note = Cobetia pacifica
ccatcgtaattgagcaagtttagtttcttgctcgtggaggtatgacctctaccctttacccccgcagatgtccggccaactatcagttatggcggcctacgtagatgctgggaacatcacaccgtgtgtgcgactgcacacggtgtgggaaataggg

SEQ ID NO: 16663 - RNA, 135 nt, unidentified
  source 1..135: mol_type = other RNA; note = Related to JWLZ01000077.1; note = Photobacterium gaetbulicola
tcgccactatttgagtgtttacactcgaggaaaatcttttgattttctgccatttacacccgcacgctccgtccacctatgtgacatgtccgtgagggatgcagacgctggcgagctagcgtctgaagactaggg

SEQ ID NO: 16664 - RNA, 164 nt, unidentified
  source 1..164: mol_type = other RNA; note = Related to NZ_LS483452.1; note = Shewanella benthica
tcgccattacattgaatgcttgcattcgtggagaactaataattctctaacatttacccccgcacaacgtcctgctcgcctcgaccttctggtacgtgatgaacaataagtggcatgtggggggactcggatacggtgcgagcgccgtatccggaaaactaggg

SEQ ID NO: 16665 - RNA, 158 nt, unidentified
  source 1..158: mol_type = other RNA; note = Shewanella phage vB_SspS_MuM16-1; note = Related to MZ568827.1
tcgccataacaagtgcctgcttttaatttggggcgtggagaagaaattctctaacattttgaccgccgcacgatgcccagcagctcatgtagttctgcatcgggatcacgtgggggggactcggctacggggcgagctccgtagccggaaaactaggg

SEQ ID NO: 16666 - RNA, 150 nt, unidentified
  source 1..150: mol_type = other RNA; note = Related to NZ_KB905161.1; note = Colwellia piezophila
ccatttagaactgaatgcttgcattcgaggagaatcttgaattctctaacctttttcccccacatgtgctcatcagataacttaacttaactatgtagcaagattggtaggggacacacaccgcgggcgaacccggtgtgtaaaacgagg

SEQ ID NO: 16667 - RNA, 139 nt, unidentified
  source 1..139: mol_type = other RNA; note = Related to NZ_KB889976.1; note = Teredinibacter turnerae
ctgttgtagttgagaggtaattctctcgcggaggtcatgagatctctaccttttgccccgcacatgcctgacctcatggttaagcagcgatgcgagagcgagcactctgtggtggcgacgccacagagtgcggaaagga

SEQ ID NO: 16668 - RNA, 169 nt, unidentified
  source 1..169: mol_type = other RNA; note = Related to JABEPJ010000003.1; note = Pseudoalteromonas sp.
aagtgtatattgagtatttatttatactcgtggaaagataatatctttctgacctcttcctgcgcacttcctgctcccccttggaaccttatggtatcaatggtaagtatcgtgaaattaagcgtaggaaggacaacgtggggcgaagaaccacgttgtgaaaatcagg

SEQ ID NO: 16669 - RNA, 173 nt, unidentified
  source 1..173: mol_type = other RNA; note = Related to NZ_JACGUS010000120.1; note = Colwellia sp.
tcgccaagtgtatttgagtatgattttatactcgcggaaagataatatctttctacccttttcctgcgcacttcctgctcccccttggaaccttatggtatcaatcggtaagtatcgtgaaattagcgttgggatagacaacgtggggcgaacccacgttgtgaaaatcaggg

SEQ ID NO: 16670 - RNA, 156 nt, unidentified
  source 1..156: mol_type = other RNA; note = Related to NC_018692.1; note = Alteromonas macleodii
tcgccaaataactggatgttttcggatgtccgtggaaagctttgctttctatcatttccctgcgcacttcctgctacccttgggcttccttggttggtatcgtgataagaccgtaggggccacaccgtgggcgaaaccacggtgtgaaaattaggg

SEQ ID NO: 16671 - RNA, 157 nt, unidentified
  source 1..157: mol_type = other RNA; note = Related to PNDR01000076.1; note = Pseudoalteromonas sp.
tcgccaaccaattgaatacctccgggtgttcgtggaaagcttaagctttctgtctttttccctgcgcaactcctgctacccttggaaatccttggttagtatcgtgagaaatacgtagggtagacaccgtgggcgaaacacggtgtgaaaattaggg

SEQ ID NO: 16672 - RNA, 130 nt, unidentified
  source 1..130: mol_type = other RNA; note = Related to PPSX01000023.1; note = Pseudoalteromonas phenolica
tcgctatcacttttaggcttttgcctgcggagatttatctctaccttttttctgcgaactgttccgttgcttgcaattgtgaatatacgtagagagacgcacgaggcgagaaactcgtgcgtaaaaggga

SEQ ID NO: 16673 - RNA, 145 nt, unidentified
  source 1..145: mol_type = other RNA; note = Related to NVVS02000010.1; note = Halomonas sp.
cactagtttattgagtgggttaccactcgcggagacatagtctctaccttttgcgccgctcatgctgccgggtcacgctagattgatccatcaagcccaagtgtgcgttcacgtcgtggggtgatgccacgacgttaaaacaggg

SEQ ID NO: 16674 - RNA, 148 nt, unidentified
  source 1..148: mol_type = other RNA; note = Related to NZ_AMRJ01000028.1; note = Alcanivorax hongdengensis
caccagtcaattgagtaggttcaacctactcgcggagacgaagtctctatattttgcgccgctcatgcagccgggtcatgctctatcgatccatcaagctcaagtgtgcgtgcacgtcgtgtggtgactacacgacgtgaaagcaggg

SEQ ID NO: 16675 - RNA, 150 nt, unidentified
  source 1..150: mol_type = other RNA; note = Related to JAFMPS010000045.1; note = Alcanivorax sp.
caccagttaactgggtaggctttgtctactcgcggagacttaggtctctaccttctgcgccgctcgtgctacgcgattcatgctccaacgattcatgcagcccaagcgtgcgtccacgtcgtgtggtgacaacacgacgtgaaagcaggg

SEQ ID NO: 16676 - RNA, 146 nt, unidentified
  source 1..146: mol_type = other RNA; note = Related to RZGU01000003.1; note = Legionella sp.
acctgttaattgaatatgtttacatattcgcggagatagagtatctctacttttcgctcggctcatgttgtttgaattgctattgatataccatgaagcacaagcgagtgtccgtcgtgcagtgacatcacgacgggttaataagg

SEQ ID NO: 16677 - RNA, 141 nt, unidentified
  source 1..141: mol_type = other RNA; note = Related to NZ_KB889904.1; note = Marinobacter sp.
tagccaagcaactgagtggaaacactcgcggagaatttattctctaccttactgggccgctagcgtcgtcatgagatcacctgtgatgtaacgtgcgagctgataccacgtgttggcgacaccacgtggtagaaacagggg

SEQ ID NO: 16678 - RNA, 128 nt, Acinetobacter sp.
  source 1..128: mol_type = other RNA; note = Related to NZ_RCHC01000004.1; note = Acinetobacter chengduensis
gcctacctatttgagtatttatactcatggagcttgtctctaactattttgcggctcatgctgtacacgtacagccacaacccgcgaaagcgcgcattcggggcgacacccgaatgcgcgaaagcaga

SEQ ID NO: 16679 - RNA, 121 nt, Acinetobacter sp.
  source 1..121: mol_type = other RNA; note = Related to JAIWSZ010000041.1; note = Acinetobacter baumannii
ccacttaatatgagtgtttcactcatggggagcttccctaacttttttgcggcacaagctgacattcagtagcaaaccgcaagagagtgcgcgccgggcgaccagcgcgcacaaaacaaga

SEQ ID NO: 16680 - RNA, 139 nt, unidentified
  source 1..139: mol_type = other RNA; note = Related to VOBE01000007.1; note = Psychrobacter sp.
tcatgaatattaggtaagttttttacctgcggaggattagaaccctctaccttttgctgggctcatgcgtcctttattcgacgtgttgtaatagttcggtatggtgcttgcttgcgacgagagcaagcaagcacctgtt

SEQ ID NO: 16681 - RNA, 140 nt, unidentified
  source 1..140: mol_type = other RNA; note = Related to AUSW01000014.1; note = Psychrobacter aquaticus
tcatgaatattaggtaagtttttttacctgcggaggattagaatcctctaccttttgctgggctcatgcgtcctttgttcgacgtattgtaatagttcggtatggtgcttgcttgcaatgagagcaagcaagcacctgtt

SEQ ID NO: 16682 - RNA, 141 nt, unidentified
  source 1..141: mol_type = other RNA; note = Related to NWFK02000001.1; note = Psychrobacter sp.
tcattaatattaggtaatattttacctgcggagaattaattttctctacctcttgccgggcacatgcgttctcgactcgacgtatcataatagctcggtatatagtgcttgcttgcgatgagtgcaagcaagcactctgta

SEQ ID NO: 16683 - RNA, 138 nt, unidentified
  source 1..138: mol_type = other RNA; note = Related to NZ_CAJHBG010000001.1; note = Psychrobacter sp.
tcatgaatattaggtaaaattttacctgcggagaattagttttctctacctcctactgggctcatgcgttctcgactcgacgtattacaatggttcggtatggtgcttgcttgcaatgagagcaagcaagcacctgta

SEQ ID NO: 16684 - RNA, 144 nt, unidentified
  source 1..144: mol_type = other RNA; note = Related to NZ_JABUZJ010000058.1; note = Psychrobacter namhaensis
tcatttaatttaggtaactatgttgcctgcggagaatgcaaattctctaactcttgctgggctcatgcgtcaattactcgacgtataataatatctcagtagtgttgttgcttgcgatgagagcaagcaacaaccttgttagga

SEQ ID NO: 16685 - RNA, 146 nt, unidentified
  source 1..146: mol_type = other RNA; note = Related to NZ_CAJHAZ010000027.1; note = Psychrobacter sp.
tcattgttatttaggtatcaattcatacctgtggagaatatttattctctaatcctttcccgggtattgtgaactctacggacacagagagcataataaccgagggttcacactcttgcgatgagcgcaagagtgtggcattggga

SEQ ID NO: 16686 - RNA, 200 nt, Citrobacter sp.
  source 1..200: mol_type = other RNA; note = Related to VHJG01000001.1; note = Citrobacter freundii
tcgcaaaagcttgatggtctgctagtcagccatcgtggaggcttcggcctctattctctccccacacgacgcatgccacacgttctcaatgttccaacgtaacgatgctaacgcatcaccagcgccttggtacatgcagcaacagttggaattgccgggttgtggcgaggggacgtcacacagtgacgtcgaatactggg

SEQ ID NO: 16687 - RNA, 202 nt, unidentified
  source 1..202: mol_type = other RNA; note = Related to NZ_FMBC01000051.1; note = Kosakonia oryziphila
tcgcaaaagcttgatggtctgcttgtcagccgtcgtggaggtttcggcctctaatctctcccccacacgacgcatgccgcgcttacgcagtgttccacgcgttacgatgctacgcatcaccgacgctctggttcgtactgggacagcttggattgctgggattgtggcgagaggacgtcacgctgtgacgtcgaaaactggg

SEQ ID NO: 16688 - RNA, 201 nt, unidentified
  source 1..201: mol_type = other RNA; note = Related to JAFJZU010000002.1; note = Pectobacterium brasiliense
tcgcaaaagcttgatggtctgcttgtcagccatcgtggaggtttcggcctctaatctctcccccacacgacgcatgccacgcttgctcaatgttccaacgttacgatgctacgcatcaccgacgctctggttcgtgccgagacagctgggattgctggatttgtggcgagaggacgtcacgctgtgacgtcgaaaactggg

SEQ ID NO: 16689 - RNA, 201 nt, unidentified
  source 1..201: mol_type = other RNA; note = Related to NZ_JAESHX010000078.1; note = Pectobacterium polaris
tcgcaaaagcttgatggtctgtttgtcagccatcgtggaggccttggcctctaatctctccccacacgacgcatgccacatgttctcaatgttccaacgttatgatgctaacacatcaccaacgctctggtactttctgtaacagttgggattgccgggattgtggcgaggggacgtcacacagtgacgtcgaatactggg

SEQ ID NO: 16690 - RNA, 193 nt, unidentified
  source 1..193: mol_type = other RNA; note = Related to JACETZ010000001.1; note = Pantoea stewartii
tcgcaaaagcttgatggtctgcatagcagccattgtggaggtttatgcctctattctctccccacacgacgcagctgttgctaacttaccgatggttcaggtgtaacgcatccatccatccggtcaatccgtaacggtctgttatgctcgtatcgtggcgagggtgacgtcacatgtgacgtcgaatactggg

SEQ ID NO: 16691 - RNA, 130 nt, unidentified
  source 1..130: mol_type = other RNA; note = Related to CP013653.1; note = Paenibacillus sp.
tcccctaaattggagtgtaacaacactcgcggagtacctttactggtattctaactcttaaaagccgacatgtggttgaccgccaccatgcggcgagccgcgcgctgggagatgcgcgcggcgaaatgaa

SEQ ID NO: 16692 - RNA, 126 nt, unidentified
  source 1..126: mol_type = other RNA; note = Related to NZ_CP040396.1; note = Paenibacillus algicola
tcccaccaactggagtgtttacactcgaggaatacttttaaagtattctaccaaaatagggcaggcgtgtggtgacacccgttcttccccaccgcgcgctgggagctgcgcgcggtgcagaatgaa

SEQ ID NO: 16693 - RNA, 134 nt, unidentified
  source 1..134: mol_type = other RNA; note = Related to JAFYLK010000105.1; note = Clostridia bacterium
tcccctcaattggaactctttgagttcgcggagcagaaatgctctaccccgaggggggcggcatgtgtttggcctgagcggtccgatgctgttcgtcctaccccagcgagcccgccgggatcgggctcgcagaa

SEQ ID NO: 16694 - RNA, 136 nt, unidentified
  source 1..136: mol_type = other RNA; note = Related to NZ_JADCKB010000021.1; note = Ructibacterium gallinarum
tcctctaaattgaagtgtacaatacacttgcggaacacatattgtgttctaccttaaacggggctacatgtagcttgaccagcccaacatggcatgcccgtccgtgcgccacaggagcttgcgcacggttaacaaa

SEQ ID NO: 16695 - RNA, 150 nt, unidentified
  source 1..150: mol_type = other RNA; note = Related to QTZF01000005.1; note = Coprococcus sp.
tcccataaattggagcgcttagcgcttgaggaacattcttaaatgtggatgttctactgttaggggccggcatgttacgcaaagacccgtagcacgctgcaagcaccgcacgctctgcctcgctcggggagctcggcagagctcaaaggg

SEQ ID NO: 16696 - RNA, 145 nt, unidentified
  source 1..145: mol_type = other RNA; note = Related to JAFBIY010000001.1; note = Faecalicatena contorta
tcccataaagtggagtgcaatagcacttgaggagcatctttgcatgctctactgttaggggccggcatgttacgcaaagacccgtagcacgctgcaagcaccgcacgctctgcctcgctcgggaagctcggcagagctcaacgga

SEQ ID NO: 16697 - RNA, 146 nt, unidentified
  source 1..146: mol_type = other RNA; note = Related to NZ_QOHO01000034.1; note = Clostridium indicum
tcccataaattggagtgtatttgcacttgaggagcatcttagtatgctctacggttaggggccggcatgttacgcaatgacccgtggcacgctgctagcaccgcacgctctgcctcgctcgggggagctcggcagagctcaatgga

SEQ ID NO: 16698 - RNA, 144 nt, unidentified
  source 1..144: mol_type = other RNA; note = Eubacteriaceae bacterium CHKCI004; note = Related to FCNR01000043.1
tcccacaaattggagtgcattagcacttgaggagtatcgtatgatactctaccttaaggggccggtatggtacgaagagacccgtagcacaccgcaagcccgcacgctctgccgagctcgggaagctcggcagagctcaaagga

SEQ ID NO: 16699 - RNA, 143 nt, unidentified
  source 1..143: mol_type = other RNA; note = Related to NZ_GL870812.1; note = Clostridium sp.
tcccataaaatggagtgcgtcagcacttgaggagtaccaattgagtactctacagttaggggccggcatggtacgtaaagacccgtggcacgcccgcaccgaacgcatcgccgagctcgggaagctcggcgatgcgcaatgaa

SEQ ID NO: 16700 - RNA, 135 nt, unidentified
  source 1..135: mol_type = other RNA; note = Related to JAFQBX010000034.1; note = Clostridia bacterium
ccccctaatctggagtatgtaaatactcgtggaacatcctatgggtgttctaattagcggggcggcacacgtgttgaccaacgatgtgctgcaccccgcggcttgcccaaggggcttgggcaagccgccaaatta

SEQ ID NO: 16701 - RNA, 136 nt, unidentified
  source 1..136: mol_type = other RNA; note = Related to CP095094.1; note = Flavonifractor plautii
tcccctaaattggagtgtataaacactcgcggaacatcttgaaggtgttctaccccacgggggcggcacacggcttgaccgcccgatgcgccgtcgcccggcatggcccaagccgggagcttgggccatgcccaaa

SEQ ID NO: 16702 - RNA, 143 nt, unidentified
  source 1..143: mol_type = other RNA; note = Related to JAFHCI010000085.1; note = Ruthenibacterium lactatiformans
tcccctaaattggagtgcatgatatgcactcgcggaacatcttcgtggtgttctaccccacggggacggcacacggcttgaccgcccgatgcgtcgccacccgtcatggcccaagccgggcgcttgggccatgaccaaaagaa

SEQ ID NO: 16703 - RNA, 138 nt, unidentified
  source 1..138: mol_type = other RNA; note = Clostridia bacterium; note = Related to JAFWRN010000131.1
tcccctcaactggagtgcattgcactcgcggagcatctttatggtgctctaccctacgggggcggcacatggcttgaccatccgatgcgccgtcacccgcatggcccagccgggaggcctgggccatgcgcaaaggaa

SEQ ID NO: 16704 - RNA, 143 nt, unidentified
  source 1..143: mol_type = other RNA; note = Candidatus Avacidaminococcus intestinavium; note = Related to DVNI01000021.1
tcccctaatctgaagcattattgcttgtgggacaattatatttgtcctaatttctaagggcagcccaagagttcaggccccgtccgactcgtatgcgtccgcagaaacggtcccggctgggatccgggaccgtttaaactgaa

SEQ ID NO: 16705 - RNA, 145 nt, unidentified
  source 1..145: mol_type = other RNA; note = Related to STFG01000036.1; note = Lampropedia sp.
agttgttggagaggtctggatacagacgttgatttgcttgataagcgtatcagcaagacggaggcgggtactaccatccgtctcttcttcgaagagagttagtcgcagggtttggccatggtggatatggctgttgccaacgact

SEQ ID NO: 16706 - RNA, 148 nt, unidentified
  source 1..148: mol_type = other RNA; note = Related to NSLA01000001.1; note = Rubrivivax gelatinosus
agttgttgggcaggtctggaaacagacgtcaatcgagtgctttatgtcgattggctagtggggagacggtcactaccgtccgtctcttcgctcgaagagagttagtcgcagggtttggccatggtggaagtggcagctaccaacgact

SEQ ID NO: 16707 - RNA, 150 nt, unidentified
  source 1..150: mol_type = other RNA; note = Related to JAHUXB010000001.1; note = Comamonas sp.
cgttgttgggtaagtctgtaaaccagacgctgacttgtgcttttgtcgcaggttggcttgtggggaggagggggcaccgtccgcctcttcgcctcgaagagagttagtcgcagggtttggccatgaagggtatggcagttaccaacgact

SEQ ID NO: 16708 - RNA, 148 nt, unidentified
  source 1..148: mol_type = other RNA; note = Related to NZ_LOXM01000118.1; note = Burkholderia ubonensis
agtcattggacattgtctggtaacagacgtcggcgttcgcaggtgatttgccggctttcggggaggggcgactaccgtccgtctcttcgccccgaagagagttagtcgcagggtttggccatgaagggcgtggcggcatccaacgact

SEQ ID NO: 16709 - RNA, 146 nt, unidentified
  source 1..146: mol_type = other RNA; note = Related to NZ_PKPC01000024.1; note = Ralstonia insidiosa
agttgtttggattagtctggaaacggacgtcaatctaatctttgttagatgacttgcggggaggagcggccaccgtccgtctcttcgcctcgaagagagttagtcgcagggtttggccatgaaaggcatggcagcttccaacgact

SEQ ID NO: 16710 - RNA, 150 nt, unidentified
  source 1..150: mol_type = other RNA; note = Related to VIVL01000004.1; note = Variovorax sp.
agttgttagataagagtctggaagcagacgtcagtctatgaagttcatagtctggcttgaggggtgaggggggttaccatccgtcccttcgtcccgaagagagttagtcgcagggtttggccatgatgggtatggcagtagctgacgact

SEQ ID NO: 16711 - RNA, 146 nt, unidentified
  source 1..146: mol_type = other RNA; note = Related to NZ_MRCN01000006.1; note = Variovorax boronicumulans
cgttgttggataagtctggaaacagacgtcgatctataagttcgtagatcggcttgcggggaggagcggccaccatccgtctcttctccccgaagagagttagtcgcatggtttggccatgaagggcatggcaggtgccaacgact

SEQ ID NO: 16712 - RNA, 148 nt, unidentified
  source 1..148: mol_type = other RNA; note = Related to NZ_CP059488.1; note = Acidithiobacillus ferrivorans
agttgttggtgatgctctgaattattagagcgtcttggttcaaaaggatcaaggcttgtcgggaggagtgataccctccgtctcttccatccggaagagagaaggacgttaggcttggccatatgaagggcggttgctaccaacagcc

SEQ ID NO: 16713 - RNA, 151 nt, unidentified
  source 1..151: mol_type = other RNA; note = Candidatus Accumulibacter phosphatis; note = Related to PDHS01000438.1
agtcgttgggcttgctcggaaacgagcgtctaaacgccactcaaaaggcgcctagacaattcgggagagggggggcaccgtccgcctcctccttcggagtagagttggtcggtaggttcagccatgggaagaatggtagctgccaacgacg

SEQ ID NO: 16714 - RNA, 150 nt, unidentified
  source 1..150: mol_type = other RNA; note = Related to SORD01000001.1; note = Janthinobacterium sp.
tatcgccggaaaatgctcgtttacgggcgtcatacagtatgtgctgtgtggcatgtggggagggccgcaagcactctcctctctctcctaacgtcgaggagaggtagttgataggcaaggtcatgggaaaagtggcagttgccggtgata

SEQ ID NO: 16715 - RNA, 145 nt, unidentified
  source 1..145: mol_type = other RNA; note = Related to JACYUQ010000003.1; note = Oxalobacteraceae bacterium
tttcgctggttaggcttggtaacaagcgtcctgtaagcattgcgatcagggctagtggggaggcaggcactctccgtctcctccgaccccgaggagagatggacgataggcttggccatgaggaagatggcagtgtccagcgaaa

SEQ ID NO: 16716 - RNA, 145 nt, unidentified
  source 1..145: mol_type = other RNA; note = Related to WKJJ01000006.1; note = Massilia rivuli
tatcgctggaagatgctcggaaacgagcgctttatggggcgacctgtaaggcacgtggggagggctcgcactctcctctcctctgaccccgaggagagatggacgataggcttggccatgggaaaagtggcagttgccagcgata

SEQ ID NO: 16717 - RNA, 148 nt, Chromobacterium sp.
  source 1..148: mol_type = other RNA; note = Related to NZ_CP029495.1; note = Chromobacterium phragmitis
cattgctagttcgtgctcgtaatgagcgttagctaggcttgcctagctaacttgtcgggagagggcttgcaccctcctctcctccggacccggaggagagagtgacggtagatttagccacgagaaagagtggcagctactagcaatg

SEQ ID NO: 16718 - RNA, 151 nt, unidentified
  source 1..151: mol_type = other RNA; note = Related to NZ_CAJNBE010000044.1; note = Paraburkholderia aspalathi
ggtcgctggacttgctcggtaacgagcgtctgacggcgttgttgctgtcaggcttgtcagaaggaggggtcatactctccgtctccccccgaccgggaggagagtgggacggtaggtttggccatgggaaggatggcagctaccagcgata

SEQ ID NO: 16719 - RNA, 156 nt, unidentified
  source 1..156: mol_type = other RNA; note = Related to NZ_CP012746.1; note = Paraburkholderia caribensis
gaccgctggacttgcctggcaacaggcgttcaacagcacctagtggtgccgttgggcttgtcagaaaggggggctcacactctccgtctcctccggacccggaggagagatggacggtaggtttggccatgggaaggatggcagctaccagcggta

SEQ ID NO: 16720 - RNA, 154 nt, unidentified
  source 1..154: mol_type = other RNA; note = Related to NZ_LPNA01000081.1; note = Burkholderia stagnalis
tgtcgttggcttgagctcggaaacgagcgcttgaagccccaatagggagttcaagctcgtcggtggggggctcacactctccgccccctccgggacccggaggagagaaggttggtaggtccggtcatgggaagagcggccgctgccaacgatg

SEQ ID NO: 16721 - RNA, 145 nt, Pseudomonas sp.
  source 1..145: mol_type = other RNA; note = Related to NZ_AUED01000023.1; note = Pseudomonas vranovensis
gatcctgggttttgctcgtacgagcgtctgaagtttttgactttggacttgtccggaggctcgcacctccgatctcctccgagaaacgtggaggagacagggacggtaggtttggccatgtgaaggatggcagctgccagcgatc

SEQ ID NO: 16722 - RNA, 145 nt, unidentified
  source 1..145: mol_type = other RNA; note = Related to SEFL01000928.1; note = Sphingobacteriales bacterium
gatcctggattttgctcgttatgagcgtctgtagcgtttgcgacaggcttgtccggaggctcgcacctccgatctcctccgaaaaacctggagtagacagagacggtgggtttggccatgtgaaggatggcagctgccagagatc

SEQ ID NO: 16723 - RNA, 144 nt, Pseudomonas sp.
  source 1..144: mol_type = other RNA; note = Related to NZ_BPLZ01000021.1
gatcctggaatttgctcgttacgagcgtctgaagcatagctttgggcttgtccggaggctcgcacctccgatcccctccgaaaaacctggaggagacagggacggtgggtttggccatgtgaaggatggcagctgccagcgatc

SEQ ID NO: 16724 - RNA, 147 nt, Pseudomonas sp.
  source 1..147: mol_type = other RNA; note = Related to NKIG01000020.1
gattctggctttgctctttaagagcgtctacgagattatatatttgtaggcttatgtggaggagccctcgcacctccgccgcctcctacccggaggagcaaggaacggtagatttagccatgtgaaggatggcagtcgccagaaatc

SEQ ID NO: 16725 - RNA, 142 nt, Pseudomonas sp.
  source 1..142: mol_type = other RNA; note = Related to JACASD010000120.1
aagcactgagcaagccttgaaaaaggcactcgttgatttataacgagtatgtccggagggggggcaccgcacgccgcctccatcctggagtagcgatagacggtaggttagccaatagaggatttggtagctatcagtgtct

SEQ ID NO: 16726 - RNA, 142 nt, Pseudomonas sp.
  source 1..142: mol_type = other RNA; note = Related to LS483433.1; note = Pseudomonas mucidolens
atgcactgagcacgccttgaaaaaggcacttattggttttccaatgagtatgtccggaggggggcaccgcacgccgcctccatcctggagtagcgatggacggtaggttagccaatagaggatttggtagctatcagtgttt

SEQ ID NO: 16727 - RNA, 139 nt, Pseudomonas sp.
  source 1..139: mol_type = other RNA; note = Related to NZ_BCBR01000170.1
caacactgagcacgcctgaaaaggcgctcgttgatgtctcggcgagcttgtccggaggggggcaccgtccgcctctcccgtcccggaatagtgaatgacggtaggttagccagagggaatttggtagctatcagtgtat

SEQ ID NO: 16728 - RNA, 148 nt, Pseudomonas sp.
  source 1..148: mol_type = other RNA; note = Related to NZ_RXHX01000002.1
cggcgctgagcaagcctttgtgaaaaggcgttcactgatgatttattagtgggcttgccggatgggggggcaccatgcgccttctcctgacccggagcagtgattgacggtaggttagccataggagatttggtagctatcggcgcat

SEQ ID NO: 16729 - RNA, 136 nt, Pseudomonas sp.
  source 1..136: mol_type = other RNA; note = Related to NZ_JAGQFP010000002.1; note = Pseudomonas stutzeri
aatgcatcgacttcgctcttaacagagcgcttgctgtttgacagcaagcatctggggcacggacggcacgatccgcttcctagagtagcgacagacggtaggttagccatagggggtttggctggatcggcgcact

SEQ ID NO: 16730 - RNA, 142 nt, Pseudomonas sp.
  source 1..142: mol_type = other RNA; note = Related to JAAMQS010000014.1; note = Pseudomonas kunmingensis
agtgcaccgtaaagctcttaggagcgctcaaagcttcaacgcaatgagcactagggacccggcgggacgatcctctatccggacccggagtagcgacagacggtaggtaagccatagagagatttggctgtatcggtgcatt

SEQ ID NO: 16731 - RNA, 144 nt, Pseudomonas sp.
  source 1..144: mol_type = other RNA; note = Related to NZ_LR134290.1; note = Pseudomonas mendocina
atgcatcgaaattgctcttaattgagcgcctgtagctatgactatgggcactccgggacaccggcgggacggttcgcctcctccgagccggagtagcgacagacggtaggttggccatggggagaaatggctgtatcggtgcac

SEQ ID NO: 16732 - RNA, 144 nt, Pseudomonas sp.
  source 1..144: mol_type = other RNA; note = Related to CP080287.1; note = Pseudomonas aeruginosa
gagcactgagaaggcctttgttgtatagaaggcgctcctatgggagcttttcgggcggagccccgcacagtgtgcgcctcctccgacccggagtagtgatggacggtaggttagccatagtggggttggcagctgtcagtgtgt

SEQ ID NO: 16733 - RNA, 157 nt, unidentified
  source 1..157: mol_type = other RNA; note = Related to NZ_CP033831.1; note = Serratia sp.
aaatactgagcatgcttagttattattagtataattgagcgccttttattgttcagaaggctaattgggagagcccctgcacacggtggcctcttccgacccggaataggggggaatgacggaaaaggcatgaggttgaagagagttgtcagtgtgt

SEQ ID NO: 16734 - RNA, 140 nt, Citrobacter sp.
  source 1..140: mol_type = other RNA; note = Related to CP055089.1; note = Citrobacter portucalensis
tttaattgactaatgccgcaaggcgcttagtttgactaagctattcgggagagggccccacgcacgcccctctctcggctacgcagagtagagttggacggtaagctcgatcatgggggttatggcagttgtcagttata

SEQ ID NO: 16735 - RNA, 140 nt, unidentified
  source 1..140: mol_type = other RNA; note = Related to JTBU02000001.1; note = Serratia marcescens
tttaactgactaaagccgcaaggcgcttagttttggctaagctattcgggagaggccacgcgcacgcccctctctcggctacgcagagtagagctggacggtaagctcgatcatggggatcatggcagttgtcagtaata

SEQ ID NO: 16736 - RNA, 140 nt, unidentified
  source 1..140: mol_type = other RNA; note = Related to MUJJ01000002.1; note = Pantoea vagans
gttaactggcaatgcctaagggcgcttggtttctccaagctacaccgggggcagcccccccgcacatgactcaactcatgaccccgagtagagatggacggtaaactcgaccatggaaaatatggcagtagtcagttaaa

SEQ ID NO: 16737 - RNA, 144 nt, unidentified
  source 1..144: mol_type = other RNA; note = Related to NZ_CP091194.1; note = Lysobacter gummosus
ggtcccgagcaatgctctgaatagagcgtccgagcttttacagctttggccactccggagggattcagtctccctctctctctaacgagaggagcgtgtgagagtaggtctagccatggggaaaaatggcagtaatcgggaagc

SEQ ID NO: 16738 - RNA, 139 nt, unidentified
  source 1..139: mol_type = other RNA; note = Related to NZ_VLXO01000050.1; note = Stenotrophomonas maltophilia
cgaacagagttttgctcatcggaaattgatgggtgcccatagggctccagagggtgacctcagtctcccgcctcccaaaaaatgcaggagcggagaatggacggcctaaccaggggttggaacgcagttgctctgtttg

SEQ ID NO: 16739 - RNA, 140 nt, unidentified
  source 1..140: mol_type = other RNA; note = Related to WELC01000020.1; note = Stenotrophomonas rhizophila
caaacagagttttgcccaccggaaaatggtgggcgcccgtaagggctccagagggaaacctcagtctcccgcctcccaaaaaatacaggagcggagaatggacagcctaaccaggggttggagcgcagttgctctgtttg

SEQ ID NO: 16740 - RNA, 145 nt, unidentified
  source 1..145: mol_type = other RNA; note = Related to NZ_CP052863.1; note = Stenotrophomonas maltophilia
gcggaaaggctttgctcgacgctctgaccggcgtcgggcgcccgtttgggctctaccgggagacctcgagtctcccgcccttcgttcctcaggagcgggggatgggtgacctagccgggaggtcggagagctgttgccttttcgt

SEQ ID NO: 16741 - RNA, 148 nt, unidentified
  source 1..148: mol_type = other RNA; note = Related to NZ_JABDRS010000003.1; note = Stenotrophomonas maltophilia
cgaagtggctttgcttggcgtcgcaaattggcgtcgagcgcccgattgggcttcgccgggaaactcccatgagtctcccgcccttcgttcctcaggagcgggggatgggcatcctagccgggaggtcggacagctgttgcctccttcg

SEQ ID NO: 16742 - RNA, 141 nt, unidentified
  source 1..141: mol_type = other RNA; note = Related to JAFRGP010000385.1; note = Rudaea sp.
cttcgccaattttgctctatgagcgctcgaggaatgttttaatctcgggcacgtctgggaggtaatactctcccgctctccgttccggagaagcgtgtggtatcaggcctagggatagagagatggcggttgttggcggaa

SEQ ID NO: 16743 - RNA, 136 nt, unidentified
  source 1..136: mol_type = other RNA; note = Related to NZ_MDDY01000002.1; note = Xanthomonas arboricola
tccagttagcattgctcgcctgagcgcatcaaagcactgctttgagcatttcggaggcttcagtctcccgccctcctttccggagaagcgcgtgttatcaggtccagggttgatgaggtggttgaagctaactggc

SEQ ID NO: 16744 - RNA, 158 nt, unidentified
  source 1..158: mol_type = other RNA; note = Related to NC_013889.1; note = Thioalkalivibrio sp.
caacgtcgatatctggcccgctaatctgaacaacctagtgggcgtcctcggagctatagagggctagaggggcgaagttcgtaccctcctctcctccgacccggaggagagattgacaataggtccgaccatgtggtgtgtggtagtagtcggcgttg

SEQ ID NO: 16745 - RNA, 164 nt, unidentified
  source 1..164: mol_type = other RNA; note = Related to JAGPVE010000007.1; note = Marinobacter sp.
gacctctaattgctcgttatgagcgttcgataattatcgaacttgtcggtaggagccccgcagggtccgccgcctctgaacccagagtagggtctccctcctctggctccagagtcgggagagacggtggagctggctgatagagttaggtggcatcagaggtt

SEQ ID NO: 16746 - RNA, 145 nt, Pseudomonas sp.
  source 1..145: mol_type = other RNA; note = Related to CP071730.1; note = Pseudomonas aeruginosa
actcgtacgtaatactgctcttaactgagcgtccgggtgacccgggcatgtcagagggtccgcaccctccctctccttccgggacccggaagagagagtgggacggtgggctacgtcatggggaacatggcagtctgatacgagt

SEQ ID NO: 16747 - RNA, 142 nt, unidentified
  source 1..142: mol_type = other RNA; note = Related to NZ_PZJP01000003.1; note = Salinicola aestuarinus
aagcagtggcattgcctgttgaaaggcaggcgtctcgagagaggctagagtgggagggggatggaccttgcgcgcgtctacccgcaccacctaaggatggtagacacggccagcaacctgtgaatggctgaggccgctgcta

SEQ ID NO: 16748 - RNA, 148 nt, unidentified
  source 1..148: mol_type = other RNA; note = Related to CP059843.1; note = Cobetia sp.
tagcattggagttgatgctccgttgaatcggggcgcctgcagcgatgcaggctcgagggggctccaagcactttggcttgggcttgtgtagcaacacctctggacggtgggcgtaatcagatgaaggcaaaggctgtagtcaatgcta

SEQ ID NO: 16749 - RNA, 145 nt, Pseudomonas sp.
  source 1..145: mol_type = other RNA; note = Related to JABEMH010000004.1; note = Pseudomonas fragi
atccgctggttagctcagtaatgagcgttcaatacctaggtattgaactgatgaggagagggccccggcagtctccgacccctgcgtcccgctggagtgtttcacggtggacctaccatgagaaaggtggtggttttcagcggat

SEQ ID NO: 16750 - RNA, 146 nt, Pseudomonas sp.
  source 1..146: mol_type = other RNA; note = Related to NZ_UUEU01000227.1; note = Pseudomonas viridiflava
atccgctggtttagctcagaaatgggcattcaatgtaattgcattgaactgatcaggagagggcaccggcagtctccgacccccgcgtcccgctggagtgcttcacggtgggcctaccatgagaaagatggtggttttcagcggat

SEQ ID NO: 16751 - RNA, 145 nt, Pseudomonas sp.
  source 1..145: mol_type = other RNA; note = Related to NZ_CP027762.1
atccgctggttagctcagtaatgagcgttcaatgcgaaagtattgaactgatgaggagagggccccggcagtctccgacccccgcgtcccgctggagtgcttcacggtgggcctaccatgagaaagatggtggttttcagcggat

SEQ ID NO: 16752 - RNA, 145 nt, Pseudomonas sp.
  source 1..145: mol_type = other RNA; note = Related to JAGYWD010000006.1
gtccgctggttagctcagtaatgagcgttcgatgcttcggtattgaactgatgaggagagggccccggcactctccgacccccgcgtcccgctggagtgcttcacggtgggccagccatgagaaagatggtggttttcagcggac

SEQ ID NO: 16753 - RNA, 155 nt, Pseudomonas sp.
  source 1..155: mol_type = other RNA; note = Related to PCQD01000007.1
gcctgttgaaatatgctctttagggcgtctagtttaatagctagacatattgggcggggccgcggcagtctccgactcccgcgctctgcgctcccgcgttgctggagtatttcatggcgagcgcaccacgagaaaggtggctgagttcaacaggt

SEQ ID NO: 16754 - RNA, 155 nt, Pseudomonas sp.
  source 1..155: mol_type = other RNA; note = Related to NZ_JAETZZ010000009.1; note = Pseudomonas putida
agtcggtgaaaatgcgtacttcggtatgcgctcagcgtttgagttgagctaatggggtggggggccccgcagtccccgacccccgcgctcccgctctcccgcaggagtatttcaaggtaggtgtagccatgtggtagtggcggtactcaccgact

SEQ ID NO: 16755 - RNA, 134 nt, unidentified
  source 1..134: mol_type = other RNA; note = Related to NZ_JAAAFX010000009.1; note = Variovorax boronicumulans
actcgttggatttgccttcgtaagaaggcgcttgcttgcaagcgtacgggaagggacctagggtcctctctccctctcggaagagagaacgtctgtagatctagccatgggaaatttggtagtttccaacgagt

SEQ ID NO: 16756 - RNA, 139 nt, unidentified
  source 1..139: mol_type = other RNA; note = Related to CP011924.1; note = Pseudoalteromonas piscicida
ttttgaggatatagcctgtgaattgcaggcgttcgttaaaaaacgaactcgtccgagggagcccgacactttcccactcaaacccagagtagaggttgacgtctaggctaggccgtttcgaggaatggcgtactcaaag

SEQ ID NO: 16757 - RNA, 141 nt, unidentified
  source 1..141: mol_type = other RNA; note = Related to PNDP01000055.1; note = Pseudoalteromonas sp.
gattttgggcttaatgcctgtattgacaggcgttcgtgaaagcgaacttgaccgaggaagcccgacaccttcccactcgaaaccaagagtagaggttgacgtctaggctaggccgttttgaggaatggcgtacccaaaatc

SEQ ID NO: 16758 - RNA, 139 nt, unidentified
  source 1..139: mol_type = other RNA; note = Related to LAHP01000027.1; note = Arsukibacterium sp.
ttgcattggtattgttcggatactcgaacgctcttatcgagcttatgagagggagccacgcgcaccctccgccactcaagaacggagtagcgtaggacggtaagcctgactttattgttctagattttaatctatgcaa

SEQ ID NO: 16759 - RNA, 135 nt, unidentified
  source 1..135: mol_type = other RNA; note = Related to PBYW01000011.1; note = Alteromonadaceae bacterium
attaatacgatattgcttacttcgagcgcccttaaaaggcttgaattggagacccgcacaccccccgccactcgcgcctctccgaggcgcagtagcgctggacggtaagcttggtcatggcagttcccgatttgt

SEQ ID NO: 16760 - RNA, 140 nt, unidentified
  source 1..140: mol_type = other RNA; note = Related to NZ_JACAVQ010000006.1; note = Aliidiomarina indica
ttcagctgatctttctgatttaaatcagaagctctcaaattggagagcaataggggagaactccgacagcctcctcaacgaaccgccgttgagttggacggtaggatcagccatggtagatagtatcattatcagctgag

SEQ ID NO: 16761 - RNA, 134 nt, Alcaligenes faecalis
  source 1..134: mol_type = other RNA; note = Related to NZ_UFSQ01000006.1
cgcgattagcatagctttttttaaaaagcgcctggttatccaggctttaaagggaagacccgatagactgtggcccccctgcaggtgtgccttgttaggattggccagcatttaattggtagtagctaatcgta

SEQ ID NO: 16762 - RNA, 138 nt, unidentified
  source 1..138: mol_type = other RNA; note = Related to NZ_BMXV01000003.1; note = Marinobacter zhanjiangensis
atgctaaagcgatgcttcatatgtatgaagcgctttgaaaaaagcacttccggcaagggacccagtcgcccctcctgctacgcagcagatgccggtgattgcacatggcccgagatgcagaggctgtttctttagcaa

SEQ ID NO: 16763 - RNA, 140 nt, unidentified
  source 1..140: mol_type = other RNA; note = Related to NZ_NIHC01000001.1; note = Marinobacter salexigens
gcgctaaagcgatgcttcatagaatttatgaagcgctttgagaaaagcacttccggcaggggatttagtcgccccaactgctacgcagtagatgtcggtgattgcacgggccggaaacgcagaggctgtttctttagcga

SEQ ID NO: 16764 - RNA, 141 nt, unidentified
  source 1..141: mol_type = other RNA; note = Related to CP034246.1; note = Shewanella algae
tcgctaaggtatgcttttaatattttagaagcgcctaaaataaggcttatccggcaaggtcgattccgtcgcccctcctgtcaagacagcagatgtcggtgattgcacaggctagaagcacagaggccgtcttcttagtga

SEQ ID NO: 16765 - RNA, 155 nt, unidentified
  source 1..155: mol_type = other RNA; note = Related to NZ_VSSP01000009.1; note = Luteimonas sp.
cgggttcggtatacgcgtactgcgtatttctagcagtgcgcgcttagcgtcaaagctaagctctaagggacatgcggttccgccgccctccgaaaccggaggagctttcccgaaggtggatcaagccagcacgagagcggcagttgctgaacctt

SEQ ID NO: 16766 - RNA, 153 nt, Proteus sp.
  source 1..153: mol_type = other RNA; note = Related to DPFJ01000041.1
aattgctagctttgcttccttatggaagcgtctgactaagtatattataagtcagactcgatccgaggccccaccgccgccagacgacggctggtgccgtagctgtcgggcattacttacggtcgtaagtagcagaggctgttgctagcaatg

SEQ ID NO: 16767 - RNA, 140 nt, unidentified
  source 1..140: mol_type = other RNA; note = Related to NZ_CP035382.1; note = Leclercia adecarboxylata
atttgctagctttgcctccttctgggggcgtctggtttaccagactcgatccgaggccccaccgtcgccaccgacggctggcgccgtagctgtcgggcattacttacggtcgtagaacgcagaggctgttgctagcaatg

SEQ ID NO: 16768 - RNA, 140 nt, unidentified
  source 1..140: mol_type = other RNA; note = Related to CP008955.1; note = Yersinia kristensenii
aattgctagctttgcttccttagggaggcgtctggtttaccagactcgatccgaggccccaccgtcgccatcgacggctggcgccgtagctgtcgggcattacttacggtcgtagaacacagaggctgttgctagcaatg

SEQ ID NO: 16769 - RNA, 140 nt, Enterobacter sp.
  source 1..140: mol_type = other RNA; note = Related to NZ_JAHEVU010000002.1; note = Enterobacter quasimori
atttgctagctttgcttccttagggaagcgtctggtttaccagactcgatccgaggccccaccgccgccaacgacggctggtgccgtagctgtcgggcattgcttacgatcgtagagaacagaggctgttgctagcaata

SEQ ID NO: 16770 - RNA, 139 nt, Escherichia coli
  source 1..139: mol_type = other RNA; note = Related to NZ_LR778152.1
atttgctagcttttgccccctagggggcgtctggttatccagactcgatccgaggccccaccgccgccaacgacggctggcgccgtagctgtcgggcattacttacggtcgtagagaacagaggctgttgctagcaact

SEQ ID NO: 16771 - RNA, 139 nt, unidentified
  source 1..139: mol_type = other RNA; note = Related to JACFXZ010000002.1; note = Pectobacterium aroidearum
aattgctagctttgcttccctagtggaagcgtctgggtaaccagacacgatccgaggccccaccgtcgccacccacggcggtgccgtagctgacggcattacttacggtcgaggaaaacagaggctgttgctagcaatt

SEQ ID NO: 16772 - RNA, 145 nt, unidentified
  source 1..145: mol_type = other RNA; note = Related to NZ_HG738868.1; note = Serratia marcescens
ttttgttagctttgctttcatttatgaaagcgtctggactaacatccagacaagttccgaggccaccaccgtcgccatccccggcgatgccgtagctgacggcattacctacggccgaggataacagaggctgctgctaacaaat

SEQ ID NO: 16773 - RNA, 139 nt, unidentified
  source 1..139: mol_type = other RNA; note = Related to CP015613.1; note = Serratia inhibens
aatcgttagattttgctttttaattaaagcgtcctttatggacctatcggtaaggccccaccatcgccacctacgatggtgccgtagccgacgacattacgtacggtcgaaaagataacactggctgctactgacgatt

SEQ ID NO: 16774 - RNA, 138 nt, Citrobacter sp.
  source 1..138: mol_type = other RNA; note = Related to CP040698.1; note = Citrobacter freundii
aatcgttagattttgctttttataaaagcgtcctctatggacatatcggcatggccccaccgtcgccaactacgatggtgccgtagccgacgacattacgtacggtcgaaaagataactctggctgctactgacgatt

SEQ ID NO: 16775 - RNA, 138 nt, Escherichia coli
  source 1..138: mol_type = other RNA; note = Related to CP088348.1
aattgtcagtttttgcttttacaaaaaagcgtccactatggacctatcagcgaggccccaccgtcgtcaactacgatggtgccgtagccgacgacattacgtacggtcgaaagatagcagaggctgttgctgacaatt

SEQ ID NO: 16776 - RNA, 154 nt, unidentified
  source 1..154: mol_type = other RNA; note = Related to NZ_CAKLIV010000013.1; note = Pectobacterium versatile
atttgtcagcttttgctttcctgaaacctttgggaaagcgtcctataaacggacatatatggaaagcgccaccgtccttgtcaacggccccggtggtgccgtagccaacggcattgcgtgcagttgctatgaacagaagctgttgctgacaagc

SEQ ID NO: 16777 - RNA, 157 nt, Proteus hauseri
  source 1..157: mol_type = other RNA; note = Related to AWXP01000008.1
ttttgttaggtattgctttaaattttatatttagagcgtccaaaatgtttggacatttccgaaggccacgaccatcgcagtcaacggcggtaaagataccgtagcctacggcatattgcacatagccgctatagagtgatggctgatgctaacaaaa

SEQ ID NO: 16778 - RNA, 160 nt, unidentified
  source 1..160: mol_type = other RNA; note = Related to NZ_OU659150.1; note = Providencia alcalifaciens
tgctgttagcttatgctttaaatcagatcaggatttggagcgccttattagcataaggcatgttccgtgggctcgaccatcgctggcaacggcgaacacataccgtagccaacggcatattgcatgtggtcgtattgaatggcggctgttgctaacagta

SEQ ID NO: 16779 - RNA, 152 nt, unidentified
  source 1..152: mol_type = other RNA; note = Related to JACYNA010000001.1; note = Pantoea agglomerans
agtttttagcttccgctctcgctaaaagtgtgagagcgcctatgcaatgcataggctggaacggaacccccacatagcctggccggcgacgatggggctgtagccgtcctcaattgcgtccggtcagagaataggggcagttgctaagaact

SEQ ID NO: 16780 - RNA, 155 nt, unidentified
  source 1..155: mol_type = other RNA; note = Related to NZ_JAENMQ010000001.1; note = Lelliottia aquatilis
gtttcttagcttccgctctcgcagtgtacatgtgagagcgcctgtgcaaacgtacaggctggaacggaacccccacaaagcctggccggcaacgatggggctgtagccgtcctcaattgcgtccggtcaaagaataggggcagttgctaagggct

SEQ ID NO: 16781 - RNA, 155 nt, unidentified
  source 1..155: mol_type = other RNA; note = Related to CP043932.1; note = Klebsiella pneumoniae
gtttcttagcttccgctctcgcaacagaaaagtgagagcgcctatgcagtagcataggctggaacggaacccccacaaagcctggccggcaacgatggggctgtagccgtcctcaattgcgtccggtcaaagaataggggcagttgctaagggct

SEQ ID NO: 16782 - RNA, 152 nt, unidentified
  source 1..152: mol_type = other RNA; note = Related to NZ_JAFMOV010000254.1; note = Rahnella perminowiae
atctcttagcgtttgctcttatgatttctaatgagagcgtctgtgttaacacagacatgtacggtgctcccacctagcctggtcggcgacgatggggccatagccgtccgcaattgcatccggtcaaggaatagaggcagttgctaagagat

SEQ ID NO: 16783 - RNA, 160 nt, unidentified
  source 1..160: mol_type = other RNA; note = Related to NZ_JAGKOO010000001.1; note = Providencia huaxiensis
aattcttagcgtttgctctcatgataattgtaaaatgagagcgtttatgtatacagtacataaacatgttcggtcccccacctagcctggccggcgacggtgaggctgtagccgtccgcaattgcatccggtcaaggaatagaggctgttgctgagaata

SEQ ID NO: 16784 - RNA, 145 nt, unidentified
  source 1..145: mol_type = other RNA; note = Related to HF933424.1; note = Yersinia enterocolitica
atcacttagcctttgctcttttaattagagagcgcctgatttattaggctcgatcggagacccccacctagcctggccggcgacgtgggacagtagccgtcggcattacatctggtcaaaggaatagaggctgttgctaagtggg

SEQ ID NO: 16785 - RNA, 147 nt, unidentified
  source 1..147: mol_type = other RNA; note = Related to NZ_CABHWQ010000046.1; note = Yersinia alsatica
accacttagcctttgctttccttgttgagggaagcgcctgtttaacaggcttgtacggaggccccccacctagcctgtccggcgacgtggggcagtagccgtcggcattacatccggtcatcggaatagaggcagttgctaagtggg

SEQ ID NO: 16786 - RNA, 151 nt, unidentified
  source 1..151: mol_type = other RNA; note = Related to CPZT01000016.1; note = Yersinia enterocolitica
accaactagcttatgctctttttttaatatgaagagcgtctgtgtaaacaggcatgtacgaaggccaccgaccctcgctggcaacgatggggcgctgtagccaacggcattacatccggtcaaacggggatagaggcagttgttaggtggt

SEQ ID NO: 16787 - RNA, 156 nt, unidentified
  source 1..156: mol_type = other RNA; note = Related to NZ_MDKE01000022.1; note = Oceanisphaera psychrotolerans
cgtatttgtcttttgctctattttatatagagcgctggagttaaaaaaccagcattgccgaggcctgcaccctatgcgcccctcccggcccttcggaccgagagtagcgaaggacgatgagcttagccagagaaatggtggcagttgacaaatata

SEQ ID NO: 16788 - RNA, 157 nt, unidentified
  source 1..157: mol_type = other RNA; note = Related to NZ_SODO01000004.1; note = Oceanimonas baumannii
cgtatttgtcgcctgctctatgttgttagatagagcgctggacgaaagttcagcatgttcctaggctgcaccctatgcgcccctcccggccctccggaccgagagtagcgatagacgatgagcttagccagagaagtggtggctgctgacaaatata

SEQ ID NO: 16789 - RNA, 142 nt, unidentified
  source 1..142: mol_type = other RNA; note = Related to BADY01000010.1; note = Pseudoalteromonas sp.
agtgtttggataatgctcttaattgagcgcttaacgttacttgttaagcttgtgcttcggccacaccctccgtctcctcgaaaccaagagtagccgtgaacgataggcttagttatagaaatggtggcagtttccaaatgtt

SEQ ID NO: 16790 - RNA, 137 nt, unidentified
  source 1..137: mol_type = other RNA; note = Related to JAHKPR010000090.1; note = Colwellia sp.
aacatttggcttgtatgcctttcacagggcgcctagcaataggcatgtgcttcggccacaccctccgactactcgaaaccaacagtagccgaggacgatgggcttaatcatagaaatggtggctgttaccaaatgtt

SEQ ID NO: 16791 - RNA, 152 nt, Vibrio sp.
  source 1..152: mol_type = other RNA; note = Related to REBK01000001.1
tatgtttacttcatgctctttatttaaagagcgctggactacggttcagcttgtgccaagccgcaccctatgcgctccgctcgccccttcggaccgagagtagcgaaggacgatgggcttagccagaggaatagtggcagttagtaagcgta

SEQ ID NO: 16792 - RNA, 155 nt, unidentified
  source 1..155: mol_type = other RNA; note = Related to UGTC01000001.1; note = Plesiomonas shigelloides
tgcactcacttaaagctctcatagattttattgtgagagcgccgaacttttaagtttcggcttgtgcctagccgcacgctaacgcaactccctcgaccgagagtagcgttggacgataagcttagccagagaaatggtggcagttagtgagtgca

SEQ ID NO: 16793 - RNA, 161 nt, unidentified
  source 1..161: mol_type = other RNA; note = Related to CP000020.2; note = Aliivibrio fischeri
aatatttgtatattgctcttaattgagcgctgaatagtgaagatctagttacttatcagcttgtgccaaggggcacaccctatgcctgcctcgtcttttgaccgagagtagtcgaggacaataggcttagccaaactaaacggtggctgtttacaaatatt

SEQ ID NO: 16794 - RNA, 157 nt, Vibrio sp.
  source 1..157: mol_type = other RNA; note = Related to BODJ01000024.1; note = Vibrio cholerae
aatatttgtatattgctcttaatagagcgctgaatagtgaagatttgattacttatcagcttgtgccaagggcacaccctatgcttgcctcggccaaaccgagagtagacgaggacgataggcttagccaaagaaatggtggctgtttacaaatgtt

SEQ ID NO: 16795 - RNA, 147 nt, Vibrio sp.
  source 1..147: mol_type = other RNA; note = Related to MCYK01000079.1; note = Vibrio lentus
tataactgaactaagctcttagctgagcgctacattaagtagcaggtgccaaggcccacaccctccatttgcctccccctccgcggaccgagagtagagggaggacgctaggtttagccagaagaatagtggcagttttcagttatt

SEQ ID NO: 16796 - RNA, 152 nt, Vibrio parahaemolyticus
  source 1..152: mol_type = other RNA; note = Related to ABGCYW010000004.1
agtgttcggtcttagctctatatggagcgccgtctattttaatagatggtctgtgcggaggcccacaccctccccttggctctcctcggcgcaagcttgagtagaacccgactaggcctgaccttatatattgttggcagtaaccgaacatt

SEQ ID NO: 16797 - RNA, 153 nt, Vibrio sp.
  source 1..153: mol_type = other RNA; note = Related to NZ_POSL01000026.1; note = Vibrio diazotrophicus
aatgttcggtcttagctcttatggagcgccgtttatctttgataaatggtctgtgcggaggcccacaccctccccttggctctcctcggcgcaagctagagtagaacctgactaggcctgaccttattatactgttggcagtaaccgaacatt

SEQ ID NO: 16798 - RNA, 166 nt, Vibrio sp.
  source 1..166: mol_type = other RNA; note = Related to NZ_CP051101.1; note = Vibrio navarrensis
gctgtttggtctttgctctttatggagcgctgtttgcattcgtgcagatagtatgtgcggaggccacaccctcgccttggctctccctcggccttacctagagtagagtatcgagagagcctcactaggcctgactttgttatatgactggcagtaaccaaacagt

SEQ ID NO: 16799 - RNA, 155 nt, unidentified
  source 1..155: mol_type = other RNA; note = Related to NZ_CP068230.1; note = Shewanella algae
ggtgttcggtcttagctctaatatggagcgccgtctgttgtcaacagatggtatgtgcggaggcccacaccctcccattggttctcctcgtcgcaagctagagtagaacctcattaggcctgaccttaatatattgttggcagtaaccgaacacc

SEQ ID NO: 16800 - RNA, 149 nt, Vibrio sp.
  source 1..149: mol_type = other RNA; note = Related to JAHUCR010000005.1; note = Vibrio fluvialis
tttggttattattgcctcaattattgaggcgctatcgacacagtcgatggtctgtgcggagggcctcgcaccctcccatcgcttctcctctacctagagtagaacctgctgggcttgatccgaaatttttctggcggatgttaaccaaa

SEQ ID NO: 16801 - RNA, 145 nt, unidentified
  source 1..145: mol_type = other RNA; note = Related to NZ_PJPV01000060.1; note = Endozoicomonas acroporae
gatcgtagagatgctcagcgatgagcgctcggaaacgagcttaccgggaaggggcgcacccttcgctgctccttggctcctccggacccggagtagcatcggacgataggcttggccagagagacattggcagatactacagatc

SEQ ID NO: 16802 - RNA, 139 nt, Aeromonas sp.
  source 1..139: mol_type = other RNA; note = Related to NZ_KQ087566.1; note = Aeromonas caviae
cgccaatagtatcagccctgttcacagggcgcctgctttagcaggcttttcgccggctcaccctccgccgtctccaaaagagactgtagcctgcggtaattggcattggttcgaaaagagatggcagaagctattggtt

SEQ ID NO: 16803 - RNA, 146 nt, Aeromonas hydrophila
  source 1..146: mol_type = other RNA; note = Related to VHIX01000003.1
cgccaatagtattagccctgtagacagggcgcctgcttacttagtagcaggctgtttcgccggctcaccctccgccgtctccaaaagagactgtagcctgcggtaattggcataggttcgaaaagagatggcagaagctattggtt

SEQ ID NO: 16804 - RNA, 144 nt, Aeromonas sp.
  source 1..144: mol_type = other RNA; note = Related to CP023817.1
cgccagtagcattagcctttgaaatatagggcgcctgcttagttgcaggctatttcgccggctcaccctccgccgtctccaaaagagactgtagcctgcggtaattggcattggttcgaaaagagatggcagaagctattggtt

SEQ ID NO: 16805 - RNA, 143 nt, Aeromonas sp.
  source 1..143: mol_type = other RNA; note = Related to JAIEYG010000002.1; note = Aeromonas veronii
cgccagtagtattagcccttgcagtttagggcgcctgcataaagcgggctttttcgccggctcaccctccgccgtctccaaaagagactgaagcctgcggtaattggcattggttcgaaaagagatggcagaagctattggtt

SEQ ID NO: 16806 - RNA, 163 nt, Vibrio sp.
  source 1..163: mol_type = other RNA; note = Related to NZ_CP019291.1; note = Vibrio vulnificus
cctattcagatgtagctctaacgagcgactgattgacgttagtttttcagtctgatgccaaggcctaccgccgccttccgcaagcaagcttgcgaccggcagcagcgttcgcgaggctcactggatcgtcggtttggataaaattaggtagtttctgatttag

SEQ ID NO: 16807 - RNA, 163 nt, Vibrio sp.
  source 1..163: mol_type = other RNA; note = Related to DS179564.1; note = Vibrio campbellii
ccggttcagatgtagctcttcggagcgactgattaacgtaagtttttcggtctgatgccaaggcctaccgccgccctccgcaagcaagcttgctcccggcagcagcgttcgcgaggctcactggatcgtcgatttgggtaagattaggcagtttctgatttag

SEQ ID NO: 16808 - RNA, 163 nt, Vibrio parahaemolyticus
  source 1..163: mol_type = other RNA; note = Related to JABCGZ010000001.1
cattacagaccatgcctttcataggcggctacctaattaatactaggtagcctgatgccaaggggtaccgccgcctcccgcaagcaagcttgctaccggcagcagcgttcgctatggctcactggattgtcggtttgggtagagataggcagtttctgtttta

SEQ ID NO: 16809 - RNA, 150 nt, unidentified
  source 1..150: mol_type = other RNA; note = Related to JADQAO010000002.1; note = Photobacterium damselae
ccatttcagattaagcccgtcatgggcgactatttattaatagtctgatgccaaggggttcaccgccgccgctcgcacgcttgcggcagtagcgttcgcaggcttcactggatagtcggtttggataaaaataggcagtttctgatttag

SEQ ID NO: 16810 - RNA, 130 nt, Acinetobacter sp.
  source 1..130: mol_type = other RNA; note = Related to NZ_VOXY01000007.1
ggtatctatctgctgattttatcagtgctagatttatctagcttgtggggagagggtcggttccgtcctatttgtcccaaataatcctgatagtcgaaggtagtagtttatgtggttatccatagatgcc

SEQ ID NO: 16811 - RNA, 137 nt, Acinetobacter sp.
  source 1..137: mol_type = other RNA; note = Related to NZ_CP067019.1
tatctatttgctgattattcttaattagcgttggggaaacctaacatgtgtggaggggatccgggttccgtcacttcctctgccaagcaagtagctgataagtgaagttaatagttgatttggtttattcttggata

SEQ ID NO: 16812 - RNA, 150 nt, Pseudomonas sp.
  source 1..150: mol_type = other RNA; note = Related to CP061850.1; note = Pseudomonas aeruginosa
cccaagttgtttggctgttttttgaacagcgatctgcaggggtgactttgtagatcacgtggggtggcgcggcagagctttcttaggctgtcgatagcgtaatctcggtgattggccgtgctcgtagagtagaggcagtccttctttggg

SEQ ID NO: 16813 - RNA, 152 nt, Pseudomonas sp.
  source 1..152: mol_type = other RNA; note = Related to NZ_LR130779.1; note = Pseudomonas oleovorans
cccgagttgtttggctgttgtgattaacagcgatctgaaagggcaacctgacaggtcatgtggggaggcggcggcataacaagctcagtttgccgacagcactatctcggtgattggccgtgctcgtagagtagaggcagaccttcttcggg

SEQ ID NO: 16814 - RNA, 144 nt, Pseudomonas sp.
  source 1..144: mol_type = other RNA; note = Related to NZ_RFFM01000002.1; note = Pseudomonas zhaodongensis
aacccgagattttgctagctgttgttaggctagcggtgttgcatgcagcgccacgtgggatggcggccaggcctcagccttggaccgacaatagacccccagtgatcggcctgacttgcagagtgaaggcggctttctttgggt

SEQ ID NO: 16815 - RNA, 188 nt, Vibrio sp.
  source 1..188: mol_type = other RNA; note = Related to PIFQ01000031.1; note = Vibrio splendidus
ctcaacggtcattactaagatttctgtaaacgtttttattggtctggcaggcattttcgccgaaaactaataggagcatattttatgtctaagttaaatctagatatccgttacacaaactcaaaaaaagacacagaactcacagttggagtcaactatgaatcttctgaagcgcaaaatgaccagag

SEQ ID NO: 16816 - RNA, 188 nt, Vibrio sp.
  source 1..188: mol_type = other RNA; note = Related to NZ_AFWF01000003.1; note = Vibrio ichthyoenteri
ctcaacggtcattactaagatttctgtaaacgtttttattggtctggcaggcgattacgccaacaactaataggagcaaaaaaaatgtttaaatttaatttacacatccgttacacaaatcaaaaagaaaacacagaactcaatgttgaagccaactatgaatcttctgaattgcaaaatgaccagag

SEQ ID NO: 16817 - RNA, 187 nt, unidentified
  source 1..187: mol_type = other RNA; note = Related to NZ_CP035780.1; note = Photobacterium damselae
ctcaacggtcattactaagatttctgtaaacgtttttattggtctggcaggcaatttcgcccacaactaataggaacaaaaaaatggcaaagattaactttcgcatccgttacacaaatcaaaagaaaaacacagaactcgatgttgcagccaactacgaatcttctgaacagcaaagtgaccagag

SEQ ID NO: 16818 - RNA, 187 nt, unidentified
  source 1..187: mol_type = other RNA; note = Related to MCUF01000038.1; note = Shewanella sp.
ctcaaaggtcattactaagatttctgtatgcgtttttattggtctggcagacaattcagtcaacaacctataaggacaaaaaaatgtttaaatttaactttaacatgcgttacacaaataaaactgaaaacacagaactcgtggttggagccaattgcgaatcatctgaacagcaagatgaccagag

SEQ ID NO: 16819 - RNA, 186 nt, unidentified
  source 1..186: mol_type = other RNA; note = Related to JACJDR010000003.1; note = Pseudoalteromonas sp.
cccaaaggtcattattaagatttctgtaaacgtttttattggtctggcagacaattaagtcaaaactaataaggaacaaaaaatgtataagttaaaactacacattatttacacgaacaaaaatgaaaacacagatattaatattttagtaaatgttgataaatctgaacagcaaaatgaccaggg

SEQ ID NO: 16820 - RNA, 189 nt, unidentified
  source 1..189: mol_type = other RNA; note = Related to NZ_AP023033.1; note = Agarivorans aestuarii
ctcaatggtcattatttagatttctggttcaaaacttattggtctggcagggcaatttcgtccacaactaataggagacattaatatgtctaagcttgatttaaatatccgttacacaagccaaaaagaaagcacagagctcactgttgaagccaactatgagtcaactgaaaagcaaaatgaccagag

SEQ ID NO: 16821 - RNA, 181 nt, unidentified
  source 1..181: mol_type = other RNA; note = Related to JAACRB010000019.1; note = Shewanella frigidimarina
ctcaacggtcattactaagatttctgttaacgtttttattggtctggcaggcacttcgctaacaacctataaggacaaaatatatgtttatatttaacatgcgttacacaagtaaaagtgaaaacacagagttcgaaattggagtcaattacgaatcctctgagaagcaaaatgaccagag

SEQ ID NO: 16822 - RNA, 191 nt, unidentified
  source 1..191: mol_type = other RNA; note = Related to LR721750.1; note = Aliivibrio wodanis
ctcaatggtcattattaagatttctgtatcaaagtttttattggtctggcagggtaatttagcccaacaaccaagaggaaacaaaaaatgaacaaatttcatttcatgatacgttacacaaataaacttaaaaacacagaactcgagattgaagccaattacgaatcttctgaacaacaaaatgaccagag

SEQ ID NO: 16823 - RNA, 187 nt, unidentified
  source 1..187: mol_type = other RNA; note = Related to PYLU01000035.1; note = Photobacterium iliopiscarium
ctcaacggtcattaataagatttctgtgaaagatttattggtctggcatggcacttttgcctcaaacccataaggatttcaatatgaaaaagtttacttttacagtacgttactcacaaaaaaataagaacacagaattcaacgttggaatcaatgctgaatattctgaacagcaaaatgacccgag

SEQ ID NO: 16824 - RNA, 198 nt, unidentified
  source 1..198: mol_type = other RNA; note = Related to WEJX01000068.1; note = Plesiomonas shigelloides
gctctgtatcatcactagtatttctgccgatgtttacctaatggtctagcagagaagtcaattctggcttccataatccagagggaatagcatatgcgcaagtcaattgtgaaagcacggtatcgcaacaaaaaaaagggcacagagtttacgtttgaagtcagacgtgaaagttctgctaaacgagatgatcagagc

SEQ ID NO: 16825 - RNA, 177 nt, Vibrio sp.
  source 1..177: mol_type = other RNA; note = Related to LIZL01000063.1; note = Vibrio splendidus
ctcaacggttattactattatttctgcttccaaatattggtctggcgaatttcgttaacaatataaggagtacaagatgaaatttaatttcaaattacgttacgttaaatcaccagaaaacacagaccttgcagttgagttaaacggcgagagttctgatacgcaagataaccagag

SEQ ID NO: 16826 - RNA, 178 nt, unidentified
  source 1..178: mol_type = other RNA; note = Related to BPET01000001.1; note = Shewanella sp.
ctcaacggttattacatatatttctgttcctgatattggtctggcgaattatcaccacaatagaaggagacattaaaatgtcatttagttttaaattatgttacgcaaaaacacgtgaaaacacagaccttgcagttgagataaacagtgaggactctgaatcgcaaaataaccagag

SEQ ID NO: 16827 - RNA, 188 nt, Vibrio sp.
  source 1..188: mol_type = other RNA; note = Related to NZ_JSTD01000043.1; note = Vibrio cholerae
ctcactggctatttatatgtatttctacaagattccttctattggtctggcgaatggttttcattagcaaacaataaggaggtctaaatgaaatcttacttcaaactacgttacagcaaatcaccagaaaacacagagctctctgttgagttaaatagagatgatactgataagcaagatagcccgag

SEQ ID NO: 16828 - RNA, 177 nt, unidentified
  source 1..177: mol_type = other RNA; note = Related to NZ_CP084222.1; note = Arsenophonus sp.
ctcagtggtcaattaaattatttctgtggctcttttggttggtctggcgaattttaaaccaacaataaggagatttatgtttatgcgtaagctaacactcaaatataaacgcattacaaagaacactgaatcgatattcgaagccgagtacgagacaaaaacacaagttgaccagag

SEQ ID NO: 16829 - RNA, 183 nt, Vibrio sp.
  source 1..183: mol_type = other RNA; note = Related to CP063377.1; note = Vibrio diabolicus
ctcaatggtcaataaaattatttctgtggctctctttattttggtctggcgaatcattcaccgccaacaataggaggcactcatgtctaagcgcaagctgaaactcaaatgtaaacacgttacaaagaacaccgagtcgattctcgaagccgagtacgagacggataaacaagttgaccagag

SEQ ID NO: 16830 - RNA, 182 nt, unidentified
  source 1..182: mol_type = other RNA; note = Related to NZ_KB907054.1; note = Psychromonas ossibalaenae
ctcaaaggtcaatatatttatttctgtcatttccaacttggtctggcgtgcaaattcgcacatgccatagaaggaaagcaaatggatagttttaatatttcattcaagttagtaaaacacacaaagaactcggacttaaacattgaagccaattttgagtctaaaacgcgagttgaccagag

SEQ ID NO: 16831 - RNA, 189 nt, unidentified
  source 1..189: mol_type = other RNA; note = Related to JAHKPW010000044.1; note = Colwellia sp.
gtgacgggttaattaaattatttctggttattccattattggtctggcgcgattaaattcgcttcacttaaataaaggagaacacaatgttaaaatttagtttttacatcagatttacgaataaaacgaagaactttagtttgatatctggaggcagtatcgaatcgaagaagcaagttaaccccgaac

SEQ ID NO: 16832 - RNA, 186 nt, unidentified
  source 1..186: mol_type = other RNA; note = Related to NYUN01000050.1; note = Haliea sp.
ctctctctgtgcgtatgctctaataaaagctcaccatttggtctggcacccaattccgggtaactaaatgtggaggtgcaatatgcacattaactttgaaataaacttagctatttgttgtagtaaaaaaagagatgactattccactagagatagtgaactagttcatagacgtaaaggagagag

SEQ ID NO: 16833 - RNA, 163 nt, unidentified
  source 1..163: mol_type = other RNA; note = Related to NZ_CP047240.1; note = Pseudoalteromonas sp.
tcaaatggttaattaatttatttctatatttcttccttggtctggcaattttaaccaaaacaggagaagaaaatgctgttaaagctatcttgcaccattaaaaccaatgaaacagagctatccttttttgcagagtttagctcggataagcaagttgacctga

SEQ ID NO: 16834 - RNA, 187 nt, Citrobacter sp.
  source 1..187: mol_type = other RNA; note = Related to CP077405.1; note = Citrobacter braakii
tgtcaggtcgacaatattaccttcatataagttatctcggtctggcggcgtaattttgcgtctaaaatcgagaaatcaactatgtttagtatctctttaaacatgcaagtgacattcaaaaaaacgaagagctcaatttcagagaaaatagatagtcctgaagttgatatgcaagtcgaccaaaaca

SEQ ID NO: 16835 - RNA, 188 nt, Enterobacter sp.
  source 1..188: mol_type = other RNA; note = Related to JAHEVB010000007.1; note = Enterobacter hormaechei
tgtcaggtcgacaatattaccttcataagcgttatctcggtctggcggcgcaatttcgcgtcctaacaatgagacaacatctatgtttactttaactttaaacatgcaagtgacgttcaaaaaaatgaagagctcaacttcagtgaaaaaagacattcctgaagttgatatgcaagtcgaccgaagca

SEQ ID NO: 16836 - RNA, 186 nt, unidentified
  source 1..186: mol_type = other RNA; note = Related to NZ_CP055904.1; note = Klebsiella aerogenes
agttaggtcgacaatattaccttcagtgaaaggctcggtctggcggcgcaataagcgtcttaattttcgaggctatgcacatgtttaatattatcttaaatctgcacgtgacatttaacaaagtaaagggctcagtagtaaagaaagtagatgttcctactactgatgagcaagtcgaccgaagca

SEQ ID NO: 16837 - RNA, 188 nt, unidentified
  source 1..188: mol_type = other RNA; note = Related to CP018628.1; note = Lelliottia jeotgali
tgttaggtcgataatattaccttcagtaaatttacttggtctggcagtgcaattctgcactataaccaaaaaggtaaatttcatgtttaatttaagcttcaatctgcaagtgacattgattaaaaacgagagctcagtttcaaagaaagtagacgttcctgaaactgaagtgcaagtcgaccgaaaca

SEQ ID NO: 16838 - RNA, 188 nt, unidentified
  source 1..188: mol_type = other RNA; note = Related to JACYNC010000004.1; note = Pantoea agglomerans
tgtttaagtcgacataatttaccttatttgacctctggtctggcggcacaattttgtgtcctaaacagagatatcaaagatgaaatttaatttcaaacttaaacttaatatgacatttggttttaaaaagggtatgacattacctaaaacagaatcaagtaatgctcatgagcaagtcgacggaaaca

SEQ ID NO: 16839 - RNA, 187 nt, unidentified
  source 1..187: mol_type = other RNA; note = Related to CP026378.1; note = Mixta calida
tgttgaagtcgacatgatttaccttatttgagctctggtctggcagcgtaattatgcgcttcaacggagatatcaaatatgaaattcaatctttcatttaaacttaaaatgacatttggttttaataagagcacggcattacccaaaacagaattaagtaatgtcagtgagcaagtcgacggaaaca

SEQ ID NO: 16840 - RNA, 190 nt, unidentified
  source 1..190: mol_type = other RNA; note = Related to CGBL01000001.1; note = Yersinia aleksiciae
tgtaagagtcgatataatttacctgaaaagaacttcggtctggccgtaccagcaggtacgcttaaacgaaggaactttacaatgaagtgtaattatactttcaacctgaaattggcatttggttttaaaaagagctcaactttacctacaaaagaaagtggtaaggtgaatgcgcaagtcgactcaagca

SEQ ID NO: 16841 - RNA, 191 nt, unidentified
  source 1..191: mol_type = other RNA; note = Related to NZ_MJIB01000008.1; note = Rahnella sp.
tgtaagggtcgatataattttcctgaacagaacttcggtctggccgtaccgtccggtacgctacgcggagtaatgaaatatgaagaagataaattataccttcaacctgaaattagcatttgatgtaaaaaagaaatataccccacctacactagaaggtggtggggtgaatgtgcaagtcgacccgaaca

SEQ ID NO: 16842 - RNA, 187 nt, unidentified
  source 1..187: mol_type = other RNA; note = Related to JAFJAP010000008.1; note = Serratia marcescens
tttttaggtcaatataattatcctgataagaaaatcttggtctggccgcaccaatatcggtgtgaaaccacaggattattcaacatgaaaattgattttaatttccgcttgacattctcaaaaaaagagagctctgtttcaaaccctcgagagaggactgagactagaaagcaaattgacctaaaat

SEQ ID NO: 16843 - RNA, 180 nt, unidentified
  source 1..180: mol_type = other RNA; note = Related to KI929259.1; note = Serratia marcescens
tattcaagtcgattattttatcctgatgtggatccttggtctggccgtacatgtgtacgattgaactgggagatacggaaatgtttacattcaaactaaaattgactatcaacaataataagagcttggtgcaaaatcttcgagagaggaattgtacgacaaagcaaattgacttgaatt

SEQ ID NO: 16844 - RNA, 188 nt, unidentified
  source 1..188: mol_type = other RNA; note = Related to QDKH01000022.1; note = Brenneria sp.
tgtttgagtcaatatattcgtccacaaatgattgcttcggtctggtgatgcaattttgcatctaagatgaggtaatatcatgaaaaagaagtatagatttaacctgaaattggcatttgatgttgaaaagagcttgactgactccgctagagatagtgatttggttgaaaagcaagttgactcaaaca

SEQ ID NO: 16845 - RNA, 191 nt, unidentified
  source 1..191: mol_type = other RNA; note = Related to NZ_WUBF01000012.1; note = Pectobacterium polaris
tgtttgagtcaatataatttatccacctatgattacttcggtctggtgatgcaattttgcatctataagaggaagtaatattatgaaaaagaaatacaagttaaacctgtcgttggcatttgattttgaaaagaacttgaccatttctgctagagatagtgatttggttgaaaagcaagttgactcaaaca

SEQ ID NO: 16846 - RNA, 180 nt, Aeromonas sp.
  source 1..180: mol_type = other RNA; note = Related to NZ_UETL01000014.1; note = Aeromonas media
ccctagagccaattatatattccggtcaatcccccttggtctggcagtcaacacgccgtgttggctttaacctggaggaattgaaaatgagtaaacgtaagaagaagtgtgttggtaagaacgctacgcgctcacgtcgagagaatgagcgtaagttactgcaacaagttggttctagag

SEQ ID NO: 16847 - RNA, 180 nt, Aeromonas sp.
  source 1..180: mol_type = other RNA; note = Related to AP024466.1; note = Aeromonas jandaei
ccctagagtcaattaaatattccagttaaagcccccttggtctggcagttggcacatcccgtgctgacgttaacctggaggtttaaatgagtaaacgtaagaaaaagtgtgttggtaagaacgctaagcgctcacatcgagagaatgagcgtaagttactgcaacaagttgattctagag

SEQ ID NO: 16848 - RNA, 196 nt, unidentified
  source 1..196: mol_type = other RNA; note = Related to RBJB01000003.1; note = Marinobacter nauticus
tacccgaagtcaatcatttaattcctgttccgttgaagtttggtctggcgctctacgtgagcataaacctactaaaatacggaggaccttatggtctatttaaagctagaagtgcaagtatcaatcagtggtaacgagaacggtcctgacctgactgagaagaaagggaaggatgaaatgcaagttgactcgggta

SEQ ID NO: 16849 - RNA, 198 nt, unidentified
  source 1..198: mol_type = other RNA; note = Related to NZ_VZZZ01000001.1; note = Marinobacter changyiensis
tactcgtagtcaatgtatatattcctgtttcggggaagtttggtctggcgctcctaggagcctaaatccattaacttaaccggaggatccacatggatcatttcaaaatagaaatacaggtaacattcgtaaacaaagagaacgcatccaagctgaatgagaatgatgctaagggtgtgaaacaagttgactcgagta

SEQ ID NO: 16850 - RNA, 196 nt, unidentified
  source 1..196: mol_type = other RNA; note = Related to NZ_LAPT01000169.1; note = Pokkaliibacter plantistimulans
tactcaaggtcaattatttttttaatccctgaatgctttggaacgtggtctggagccctacttttggggccataactaacgcagaaggagcatgttatgaatatttctattcgtatttctatcgtaaaattgaacaagggcaaatccaatccaaccgagagggaggtgcggattaaaaagcaaattgacctgagta

SEQ ID NO: 16851 - RNA, 196 nt, Pseudomonas sp.
  source 1..196: mol_type = other RNA; note = Related to CP033104.1
cacttgagctaatagtaatattccttgactgcttactccacttggtctggccacagatgcgaatttctcgcttctgcatgctgagaggataaagcgatgttttacatgaaacctgatgtacctgtgactgttccaaaagagagcgttcccgaagtgcctagagatagtcctttgtggaaaagagttggctcaagtg

SEQ ID NO: 16852 - RNA, 195 nt, Pseudomonas sp.
  source 1..195: mol_type = other RNA; note = Related to JAEHTA010000001.1; note = Pseudomonas monteilii
cactaaagccaatattactattccttgattgcttactccgattggtctggccgacgggggcgaattttcgtccccgcatacctgaggatgtagcgatgcttaacgcaaaaccagctgtacctgtgactgttaaacaaaagggcgttcccgaagtgactagagatagtcctctgtggaaaagaattggctctagtg

SEQ ID NO: 16853 - RNA, 196 nt, Pseudomonas sp.
  source 1..196: mol_type = other RNA; note = Related to NZ_CP077075.1; note = Pseudomonas xanthosomae
cgcttgagtccaatattaatattccttgaatgcttaatccgcttggtctggccacaagagcatttcgctcttggttgctaagaggaaaaagctatgcgtaaagctaaatcagatgtacctgtgactgttacagaaaaagagagcattccggaagtaactagagatagttctccttggaaaaaaattggctcaagtg

SEQ ID NO: 16854 - RNA, 197 nt, Pseudomonas sp.
  source 1..197: mol_type = other RNA; note = Related to NZ_UWAB01000407.1; note = Pseudomonas viridiflava
cattcaagtcaatattaatattccctgatctgcttgatccaattggtctggcgtcggaggtgaattcctcgccttcgcgtgctgaaaggaaaaagcgatgcttcaaatcaaaatcgttgtacttgtgactggtaacaaagagagcgttcgtggggtgcctagagatagtccctcgcggaaaagaattgactcgaatg

SEQ ID NO: 16855 - RNA, 196 nt, Pseudomonas sp.
  source 1..196: mol_type = other RNA; note = Related to AE016853.1; note = Pseudomonas syringae
catttgagtcaatacaaatattccttgagatgcttaatccaattggtctggccgtgacgacagaattctctgtcttcacaacaagagggtttcgcaatgttcgatgttaaaattgaaatacatatggctggtagaaagaagagcattcccgtagtagctagagatagcacatcggggaaaagaattggctcaaatg

SEQ ID NO: 16856 - RNA, 190 nt, Pseudomonas sp.
  source 1..190: mol_type = other RNA; note = Related to CP054472.1; note = Pseudomonas aeruginosa
cacttgagctgataatattattccttgcttattttctcttggtctggcggaggggtaattccgccccttcatagcctggagtgaatagaaatgatatttttcaatatcaacatatacgtgactagtaaagaaaagagcattcgctcagaagctagagatagctctgttgtgaaagggattagctcaggtg

SEQ ID NO: 16857 - RNA, 190 nt, Pseudomonas sp.
  source 1..190: mol_type = other RNA; note = Related to JAHUVZ010000002.1
cacctgagctgataatattattccttggttatatttctcttggtctggcggagaggtaatttcgcctcttcaaaacctggagtaaatagaatgatattttttaatatcaacatatacgtgactagtaaagaaaagagcattcgtgcggaagttagagatagctccgttacgaaagggattagctcaggtg

SEQ ID NO: 16858 - RNA, 192 nt, Pseudomonas sp.
  source 1..192: mol_type = other RNA; note = Related to NC_018028.1; note = Pseudomonas stutzeri
cacctgagataataatattgttccttgtttgatttctcttggtctggcgacagtcgacattccgccggctgcaaatcaagaggttttaaaagatgatatatttcaatatcaacgtatatgtgacttacgagaaaaagagcattcttccgaaaaccagagatggttccggtgagaaaagggttatctcaggtg

SEQ ID NO: 16859 - RNA, 190 nt, Pseudomonas sp.
  source 1..190: mol_type = other RNA; note = Related to QJRF01000029.1; note = Pseudomonas taiwanensis
cacctgaattaataatattgttccttgtgctcaaactcttggtctggcgacagataacacccgttatctgcatatcaggaggactgaagaatgattttcttcaacatcgtaataaacgtgactggttgttctaagagcgttcgttcggaagtgggagaccgccccgatacggaaagggttagttcaggtg

SEQ ID NO: 16860 - RNA, 193 nt, Pseudomonas sp.
  source 1..193: mol_type = other RNA; note = Related to NZ_FRBQ01000013.1; note = Pseudomonas punonensis
cacctgagttaataatattgttccttgtgcttcaactcttggtctggcgacaggtgacaatcgtcacttgcatatcgagagggtaataagatgatagttgtcaatgtcgtcatcaacgtgactggttgtaaaaaagagagcattcgcccggaagtgggagaccgccccgaagcgaaaagggttaattcaggtg

SEQ ID NO: 16861 - RNA, 197 nt, Pseudomonas sp.
  source 1..197: mol_type = other RNA; note = Related to QTSW01000011.1; note = Pseudomonas lactis
catctaaaccaatattaatattctttgtgctaaagctcttccttggtctggctacaggtatgcattccgcaaacctgattgcaaggagaactaaccgatgattatcatcagtgttaatgtgcgcgtgactggtaaaaaaaagagcattcctaagaactccagagatggggtcggtcggaaaaaaattggtttagatg

SEQ ID NO: 16862 - RNA, 195 nt, Pseudomonas sp.
  source 1..195: mol_type = other RNA; note = Related to NZ_CP043571.1; note = Pseudomonas migulae
catctgaaccaatattaatattctttgtgcttaaattcttccttggtctggctacaggtaggcattccgtttacctgctgcaaggagaaaacttgatgatcttcatcaatgtaaacatcaccgtgactggtaaaaatgagagcattccttcgaagtccagagatggggtcggtgggaaaaaaattggttcggatg

SEQ ID NO: 16863 - RNA, 193 nt, Pseudomonas sp.
  source 1..193: mol_type = other RNA; note = Related to CP073082.1; note = Pseudomonas aeruginosa
cacctagttcaatattaatatcccttgtctccggcggaattggtctggcgcgtcctagtggcgcatatatcaattacttaaggagttataacgatgtatattctggttgttgtaaaattttctaagaaagtaaagagcactcagccggttggtggagacactactggattgggcaaaaaaattgtactaggtg

SEQ ID NO: 16864 - RNA, 191 nt, Pseudomonas sp.
  source 1..191: mol_type = other RNA; note = Related to NZ_CP027733.1
ctcttaagtcaatatacatattccttgctgtttctctctttggtctggccggacatcgcacttttgcgttgttcattcgaggagaaaagcgatgtataaactacatgttgtaatctacgtgactagaaaaaataagagcattcgtacgaagcttggagacaggctcgcaacgaaaggaattgacttaagag

SEQ ID NO: 16865 - RNA, 204 nt, unidentified
  source 1..204: mol_type = other RNA; note = Related to NZ_OBMO01000006.1; note = Alcanivorax xenomutans
tatctagcactagtaagaatattccttctgatcactccttggtctggcggtggtgcaattcagcatcatcacaactaaaaaggagaactcgaatgcatttattaatgtatttcaaaattaagatcagcctaacgttttgtaaaaagagctcgagcgaccatcccttagaagggtggccagctgacaagcaaactatgctagata

SEQ ID NO: 16866 - RNA, 185 nt, unidentified
  source 1..185: mol_type = other RNA; note = Related to NZ_FUKJ01000432.1; note = Crenothrix polyspora
ccatataatcaatatttatattctcgcgttccttttgttggtctggcgtggcgtttgccacaattaacttcaatcgaggaaacaaatgcaaaataatattcatattaccgtagtaattaaagcaactgagagcaacgatttgcaacagccccacgctgtacaagttgaaaaacaagttgattcgg

SEQ ID NO: 16867 - RNA, 190 nt, unidentified
  source 1..190: mol_type = other RNA; note = Related to PERX01000093.1; note = Methylobacter sp.
caaaataatcaatccttatattctcgtctcctaagttattggtctggcgtggcatagccacaaatccccttaacagaataaaggtaaacaaatgaacactgatattaaaatcaccgtagtaatcaaaaaaaccgagagcaacgatttacaacagccccaagctgttaaagtcgaaagacaagttgatttg

SEQ ID NO: 16868 - RNA, 177 nt, unidentified
  source 1..177: mol_type = other RNA; note = Related to NZ_CP014360.1; note = Methylomonas sp.
ccaaataatcaatctcaatattctcgtttccttagttattggtctggcattttttaaccctaaccaaggagatagcaatgaaatgtgacattcacattaacgtagtaattaatgaagtcaagagtataagtttgcaacagccccacgctttgcaaacgaaacaacaagttgatttgg

SEQ ID NO: 16869 - RNA, 175 nt, unidentified
  source 1..175: mol_type = other RNA; note = Related to JACYUQ010000012.1; note = Oxalobacteraceae bacterium
tgtccatccaatagttgtatccccatttctccgaagcttggtctggcccatttcaaccagcaaaggagtaataacatgaaccatcgttataaaatgacgttctcatttgagaaaaaaagcagtaaagacaatcggagcggttcggttgaaactgacctgcgagttggatcggaca

SEQ ID NO: 16870 - RNA, 213 nt, unidentified
  source 1..213: mol_type = other RNA; note = Related to NZ_AQXY01000025.1; note = Thioalkalivibrio sp.
tgcctgattccaatacaccaattcccgatgctctgaatgtttggtctggcgctaaacgaaatccgtcgtttagccaaaaacataaggagtaacaaatgaaacgagcaatcgtgcatgtgtcagtgaccgtcctttttcgacaagaggacacagatagcgcggaacgtaccgctcgagagagccacgattccgaaacgcaggttggatcaggca

SEQ ID NO: 16871 - RNA, 171 nt, Escherichia coli
  source 1..171: mol_type = other RNA; note = Related to NZ_CP050193.1
ccaaagagccaatagagtttttccttgctttcctactggtctggcaaaatttcataaccaataggagttgcatcatgtttattatcaacatcaacattaacgtaaccaagagctcttcatcttgttctggagacggtcagatgaagaaaaaaagagaggttggctctctgg

SEQ ID NO: 16872 - RNA, 147 nt, unidentified
  source 1..147: mol_type = other RNA; note = Related to CP068315.1; note = Klebsiella pneumoniae
accaatttttccttgctttcctatggtctggcaaaatttcacaaccactaggagcagtactatgtttattttcaacatcaacatttacgtaaccaagagctcttcatcttgttccggagacggacagaagaagaaaaaaagagaggt

SEQ ID NO: 16873 - RNA, 172 nt, Escherichia coli
  source 1..172: mol_type = other RNA; note = Related to DADHSI010000124.1
cctaagcgctgatagatttattcctttggttttccctggtctgacagaaatcaaaccaaaacggagaaacaaagtatgtttaacatcaacatcaatatcactgtgattaagagcgcttcaactaaatctggagacagaaagaagaagcaaaagaaagagatcggcgctaagg

SEQ ID NO: 16874 - RNA, 173 nt, unidentified
  source 1..173: mol_type = other RNA; note = Related to NZ_CP083739.1; note = Hafnia paralvei
ccctaaagccaattgatttattccttgtgttccttactggtctggcaaaacccataacccaagaaggaaggcaaaaatgttaaattttaacatcaacttaagtgtaactaagacctataactatgcatctggagacagtcatagtcgtagaaaagaagggattggctttatgg

SEQ ID NO: 16875 - RNA, 177 nt, unidentified
  source 1..177: mol_type = other RNA; note = Related to MECU01000027.1; note = Shigella sp.
ccctaaagccaattgatttattccttgtgttccttactggtctggcaaaacccaacaaccaaagaaggaagactagaatgtttaaatttaacatcaacttaagtgtaattaataagacctacaattacggaactggagacagtagtagtcgtagaaaaaaagggattggctttatgg

SEQ ID NO: 16876 - RNA, 170 nt, unidentified
  source 1..170: mol_type = other RNA; note = Related to NZ_WVWD01000013.1; note = Leclercia adecarboxylata
cccattagccaatagatgtgttccttgtcttctttcactggtcaggcaaaatttatctaaccatggagaagaaaaaatgatttcaatcaacttgaatatcaacgtgactaagagctattactcattttctggagacagaaagagtaagaaaaaagagattggcttgatgg

SEQ ID NO: 16877 - RNA, 164 nt, unidentified
  source 1..164: mol_type = other RNA; note = Paludibacteraceae bacterium; note = Related to JAGNRY010000075.1
tatagctaacaacacaattccttgttccataacggtcaggcaaaacttaaccaaccgagaggaaccaagcatgtttaatttaaatattagtatctgcagcattagtgtgacaaagagccattaccagacaactggagacagtactggtaaaattgatagcaata

SEQ ID NO: 16878 - RNA, 183 nt, unidentified
  source 1..183: mol_type = other RNA; note = Related to CP066129.1; note = Morganella morganii
ccttgagtcaataatatatcccttgttccattacggtcaggcaagttatcaacaaccgaaaaggaacaaatatgtttaatttaacaattagcattagtattaaaagcattaccatgacgaagagctactgccaaccttctggagacagagatggtagtattaacaaagggattggcttcaagg

SEQ ID NO: 16879 - RNA, 176 nt, Pseudomonas sp.
  source 1..176: mol_type = other RNA; note = Related to NZ_UUIA01000028.1; note = Pseudomonas viridiflava
ccctcagattgatagatttattccttgtcttctttatggtctggcaaaactcaaccagcaaggagatgaaccgatgatttttctcatcgtagtaaatgtaaacgtgaatggcggtacaaagagcaaagagtctgatactggagacagtcagcctctgaaaaggattgatctgaggg

SEQ ID NO: 16880 - RNA, 196 nt, unidentified
  source 1..196: mol_type = other RNA; note = Related to NZ_SOBR01000014.1; note = Chromohalobacter marismortui
tccctattccaacatttatttctttgcaaagcacaaccattggtctggcaactctagccataggggttagggggtgacaatgggagtaatgtaatgaagctaaaactaagctttaatgtgcgtctaaacattagctgtaaagagcctgcgaaatcatctagagatagaacttcgcaggaaggagttggaataggtg

SEQ ID NO: 16881 - RNA, 198 nt, unidentified
  source 1..198: mol_type = other RNA; note = Related to NZ_NSKA01000004.1; note = Halomonas sp.
tagttattccaatatttttttctttgtcacgcattaccactggtctggcaatcctgtcctaatcctgggacgggtagacaagaggtaagaagatgaaattcaacatgaatcttaacttgcgtttcagcatgggcagcaagaaagagtctcgaaagaaacctagagataggtcttttgaggaaggggttggaatagcta

SEQ ID NO: 16882 - RNA, 195 nt, unidentified
  source 1..195: mol_type = other RNA; note = Related to CP040452.1; note = Halomonas sp.
tccttaatccagtactattattctttgcattgcgcacctattggtctggcagatccctgtccatcgactgggacaaaccaagaggtatcatgatgaaaattttagtaatcattaaattgcgcaaaagcattagttgtaaagagtctgcctgcgtttctagagataggagtaggcaggaaggaactggattaggtg

SEQ ID NO: 16883 - RNA, 195 nt, unidentified
  source 1..195: mol_type = other RNA; note = Related to JABFTW010000016.1; note = Halomonas sp.
ctcacatccaacattcaattctttgcgcgtgtggaaaacctcggtctggccggtcaaccatgtcggttggctgtaacctgaggagtattacgatgaaaatcgaaaataccactgttatccgcatcagtaatagctgcaaagagtttggttcttcacctagagataggcagaaccaagaaggagttggagtgagag

SEQ ID NO: 16884 - RNA, 218 nt, unidentified
  source 1..218: mol_type = other RNA; note = Related to NZ_CP043568.1; note = Comamonas testosteroni
gtcagttgctagttgttattctcttggagccgattgagtgttgtgcggcgcattaattttgatgcgccataactcatgaggtaccaaaatgggaaatacccaaacgcaaaactgttcaaaaatcgaaatcattaatagcaatattaatgtgaacgtaacggtaaaagtgatttacgtgcgagagcaggtaaatcataaaagcagcgctcgcagctggc

SEQ ID NO: 16885 - RNA, 192 nt, unidentified
  source 1..192: mol_type = other RNA; note = Related to CP074381.1; note = Cupriavidus necator
tgccggcgcgggttatttgctctctttcgtgactcgtttaggtgtaggcggatttgcttgcaaatctataaccgaaaacgaggtatcacatgacaaatattgttgtaaacgtaaccactattgttgttcagaactcagttgtgagtggtcgggaggccgccattcgcaatgataagcccgccagcgtcggca

SEQ ID NO: 16886 - RNA, 153 nt, Vibrio parahaemolyticus
  source 1..153: mol_type = other RNA; note = Related to KK081893.1
actctttagcttaggactatttagtctagtcgggtgtttagccagactctaatttattgaacgggtttatggttgcgataggttcgcaacctgatctcctcactacgttcgtcaatcaggttgcgaacctatcgcttcctctagtaaagagtt

SEQ ID NO: 16887 - RNA, 153 nt, Aeromonas sp.
  source 1..153: mol_type = other RNA; note = Related to NZ_JTBG02000005.1; note = Aeromonas caviae
gctctttagcttaggacaaatttgtctagtcgggtgtttagccagactctaatttattgaacggttttatggttgcgataggttcgcaaccagatctcctcactccgttcgtcaatctggttgcgaacctatcgcttcctctagtaaagagtt

SEQ ID NO: 16888 - RNA, 153 nt, Vibrio sp.
  source 1..153: mol_type = other RNA; note = Related to AAXMWT010000001.1; note = Vibrio vulnificus
actctttagcttaggacgaattcgtctagtcgggtgtttagccagactctaatttattgaacggttttatggttgcgataggttcgcaaccagatctcctcactccgttcgtcaatctggttgcgaacctatcgcttcctctagtaaagagtt

SEQ ID NO: 16889 - RNA, 153 nt, unidentified
  source 1..153: mol_type = other RNA; note = Related to PZOH01000095.1; note = Photobacterium damselae
gctctttagcttcggacgaattcgtctagtcgggtgtttagccagactctaacttattgaacggttttatggttgcgataggttcgcaaccagatcttctcactccgttcggcaatctggttgcgaacctatcgcttcctttagtaaagagtt

SEQ ID NO: 16890 - RNA, 153 nt, Vibrio sp.
  source 1..153: mol_type = other RNA; note = Related to NZ_RSFA01000069.1; note = Vibrio pectenicida
gctctttagcttaggacgaattcgtctagtcgggtgtttagccagactctaatttattgaacggttttatggttgcgataggttcgcaacctgatctcctcactccgttcgtcaatcaggttgcgaacctatcgcttcctctagtaaagagtt

SEQ ID NO: 16891 - RNA, 153 nt, unidentified
  source 1..153: mol_type = other RNA; note = Related to WMCU01000006.1; note = Photobacterium phosphoreum
gctctttagcttaggacgaattcgtctagtcgggtgtttagccagactctaatttattgaacggtgttatggttgcgataagttcgcaacctgatctcctcactccgttcgtcagtcaggttgcgaacttatcgcttcctctagtaaagagtt

SEQ ID NO: 16892 - RNA, 145 nt, unidentified
  source 1..145: mol_type = other RNA; note = Related to WOBA01000001.1; note = Aliivibrio fischeri
actctttagcttaggacgaattcgtctagtcgggtgtttagccagactctaatttattgaacggcattatggttgcgataggtccgcaacctgatctcgttcctcaatcaggttgcgaacctatcgcttcctctagtaaagagct

SEQ ID NO: 16893 - RNA, 153 nt, Vibrio sp.; identical to SEQ ID NO: 16890
  source 1..153: mol_type = other RNA; note = Related to NZ_CP051108.1; note = Vibrio fluvialis

SEQ ID NO: 16894 - RNA, 153 nt, unidentified
  source 1..153: mol_type = other RNA; note = Related to NZ_MUFR01000019.1; note = Salinivibrio costicola
gctctttagcttaggacgaatccgtctagtcgggtgtttagccagactctaatttattgaacggttttatggttgcgataggttcgcaacctgatctcctcactccgttcgtcaatcaggttgcgaacctatcgcttcctctagtaaagagtt

SEQ ID NO: 16895 - RNA, 153 nt, unidentified
  source 1..153: mol_type = other RNA; note = Related to JAKRFY010000043.1; note = Pseudoalteromonas sp.
gctctttagctcaggacgaatacgtctagtcgggtgtttagccagactctaatttattgaacggttttatggttgcgataggttcgcaacctgatctcctcactccgttcgtcaatcaggttgcgaatctatcgcttcctctagtaaagagtt

SEQ ID NO: 16896 - RNA, 153 nt, unidentified
  source 1..153: mol_type = other RNA; note = Related to NZ_FLRB01000014.1; note = Marinomonas gallaica
gctctttagcttaggacgaatacgtctagtcgggtgtttagccagactctaatttattgaacggttttatggttgcgataggttcgcaacctgatctcctcactccgttcgtcaatcaggttgcgaacctatcgcttcctctagtaaagagta

SEQ ID NO: 16897 - RNA, 146 nt, unidentified
  source 1..146: mol_type = other RNA; note = Oceanospirillaceae bacterium; note = Related to JABSRB010000040.1
actctttagcttaggacgaattcgtctagtcgggtgtttagccagactctaatttattgaacggctttatggttgcgataagatcgcaacctgatctcgtacctcaatcaggttgcgatcttatcgcttcctcttagtaaagggtt

SEQ ID NO: 16898 - RNA, 145 nt, Pseudomonas sp.
  source 1..145: mol_type = other RNA; note = Related to NZ_JAEIOI010000003.1; note = Pseudomonas anguilliseptica
gctctttagcttaggacgaactcgtctagtcgggtgtttagccagactctaagttattgaacgagattgtggttgcgatagtctcgcaacctgatttcgttcctcaatcaggttgcgagactatcgcttcctctagtaaagagtt

SEQ ID NO: 16899 - RNA, 145 nt, Pseudomonas sp.
  source 1..145: mol_type = other RNA; note = Related to NZ_FRBQ01000002.1; note = Pseudomonas punonensis
gctctttagcttaagacgaatccgtctagtcgggtgtttagccagactctaagttattgaacgacattgtggttgcgatagtctcgcaacctgatctcgttcctcaatcaggttgcgagactatcgcttcctctagtaaagagtt

SEQ ID NO: 16900 - RNA, 145 nt, Pseudomonas sp.
  source 1..145: mol_type = other RNA; note = Related to NZ_JACKQK010000005.1
gctctttagcttaagacgattccgtctagtcgggtgtttagccagactctaagttattgaacgattttgtggttgcgatagtctcgcaacctgatctcgttcctcaatcaggttgcgagactatcgcatcctctagtaaagagct

SEQ ID NO: 16901 - RNA, 146 nt, unidentified
  source 1..146: mol_type = other RNA; note = Related to NZ_FRDS01000164.1; note = Moritella viscosa
gctctttagcttaagacgaatttcgtctagtcgggtgtttagccagactctaatttattgaacgacattatggttgcgatatgttcgcaaccagatctcgtacctcaatcaggttgcgaacatatcgcttcctctagtagagagca

SEQ ID NO: 16902 - RNA, 146 nt, unidentified
  source 1..146: mol_type = other RNA; note = Related to NZ_WEIA01000002.1; note = Pseudoalteromonas maricaloris
gctctttagcttaggacgaaattcgtctagtcgggtgtttagccagactctaatttattgaacgactttatggttgcgatatgttcgcaaccgtcattcgttcctcatgaaggttgcgaacatatcgcttcctctagtaaagagca

SEQ ID NO: 16903 - RNA, 146 nt, unidentified
  source 1..146: mol_type = other RNA; note = Related to JAERPS020000004.1; note = Rheinheimera sp.
gctctttagcttaggacgacattcgtctagtcgggtgtttagccagactctaatttattgaacgactttatggttgcgatatgttcgcaaccgtctttcgttcctcaagaaggttgcgaacatatcgcttcctctagtaaagagca

SEQ ID NO: 16904 - RNA, 147 nt, unidentified
  source 1..147: mol_type = other RNA; note = Related to NHNK02000003.1; note = Marinomonas agarivorans
tctctttagttttagggcgaaattcgtctagtcgggtgtttagccagactctaacttattgaacgactttatggttgcgatatgtgcgcaaccattactcgttcctcatgatggttgcgcacatatcgcggcctctagtaaagagct

SEQ ID NO: 16905 - RNA, 142 nt, unidentified
  source 1..142: mol_type = other RNA; note = Related to JAESQF010000097.1; note = Oleispira sp.
actctttagctttggacgaatttgtctagtcgggtgtttagccagactctaatttattgaacggttttgtattgcgagacatcgcgatctaagctcgttcctcacttagatcgcgatgcctcgcgatcttgagtaaagagta

SEQ ID NO: 16906 - RNA, 146 nt, unidentified
  source 1..146: mol_type = other RNA; note = Related to NZ_AULO01000011.1; note = Marinospirillum minutulum
actctttagaactaggacgaattcgtctagtcgggtgtttagccagactctaacttattgaacgggtttatgcttgcggtgtttccgcaaccttaactcgttcctcattaaggttgcggaaacaccgcttcctctagtaaagagca

SEQ ID NO: 16907 - RNA, 151 nt, unidentified
  source 1..151: mol_type = other RNA; note = Related to NZ_RPGH01000128.1; note = Candidatus Enterovibrio escacola
gctctttagcgttggacgatattcgtattcgtctagtcgggtgctcagccagactctaacttattgaacgacttgacggtgcgatatgttcgcaaccttcactcgttcctcatgaagcttgcgaacatatcgcattctctagtaaagggct

SEQ ID NO: 16908 - RNA, 143 nt, Chromobacterium sp.
  source 1..143: mol_type = other RNA; note = Related to JAHDTB010000015.1; note = Chromobacterium subtsugae
gctctctagcttaggactctatgtccagtcgggtgtttagccagactctaatttattgaacggtttggggttgcgaaagactcgcatcctaaactcgttcctcatttaggatgcgagtctttcgcttcctctagtagagagtg

SEQ ID NO: 16909 - RNA, 145 nt, unidentified
  source 1..145: mol_type = other RNA; note = Related to NZ_CP019697.1; note = Paenalcaligenes hominis
actctttagcgtatgacggattacgtcagtcgggtgtttagccagactcaaatttattgaacggttttggggttgcgctaggcgcacaaccttaactcgttcctcattaaggttgtgcgcctagcgcttcctttagtaaagagta

SEQ ID NO: 16910 - RNA, 144 nt, unidentified
  source 1..144: mol_type = other RNA; note = Related to CP065725.1; note = Oligella ureolytica
actctttagcgtatgacggaatacgtcagtcgggtgattagccagactcaaattgattgaacgggtttaaagttgcgtgatgtacgctttcttagctcgttcctcgccaagaaagcgtacatcacgctctttcaagtaaagagt

SEQ ID NO: 16911 - RNA, 145 nt, Aeromonas sp.
  source 1..145: mol_type = other RNA; note = Related to NZ_CP083625.1; note = Aeromonas enteropelogenes
gctctttagcgttggacggttacgtctagtcgggtgcttagccagactctaagttattgaacggcattatggttgcgatagtctcgccacctaatctcgttcctcgtttaggtggcgagactatcgcttcctctagtaaagagct

SEQ ID NO: 16912 - RNA, 96 nt, unidentified
  source 1..96: mol_type = other RNA; note = Related to FO818637.1; note = Xenorhabdus bovienii
gctctttagcggtttggacaaacttcgtctagtcgggtgattagccagactctaacttattgaacacgtttaattcgctgtctttagtaaagagta

SEQ ID NO: 16913 - RNA, 101 nt, unidentified
  source 1..101: mol_type = other RNA; note = Thiotrichaceae bacterium; note = Related to CACVAY010000001.1
attgaacggctttagggtgcgatgttttcgcattctaagctcgtcagcttgttgcttcctcccttagaatgcaaaaacatcgcagtctttagtaaagagcc

SEQ ID NO: 16914 - RNA, 145 nt, Vibrio sp.
  source 1..145: mol_type = other RNA; note = Related to AAXMUQ010000002.1; note = Vibrio alginolyticus
actctttagtgttggacgcaaattcgtctagtcgggtgattagccagactcaaatttattgaacgggtttaaatgcgaggtgtacgcatcctaaactcgttcctcctttaggatgcgtacacctcgcaccttctagtaaagagcc

SEQ ID NO: 16915 - RNA, 144 nt, Vibrio sp.
  source 1..144: mol_type = other RNA; note = Related to NZ_CP022741.1
actctttagtgtaagacgtaattcgtctagtcgggtgattagccagactcaaatttattgaacaggtttaaatgcgaggtgtacgcatcctaaactcgttcctcctttaggatgcgtacacctcgcactctttagtaaagagtt

SEQ ID NO: 16916 - RNA, 107 nt, Chromobacterium sp.
  source 1..107: mol_type = other RNA; note = Related to NZ_MUKV01000069.1; note = Chromobacterium haemolyticum
actctttagtgtaggacggtcatcgtctagtcgggtgtttagccagactctaacttattgagcggatttatggttgcgataggatcgcatcctcctagtaaagagcc

SEQ ID NO: 16917 - RNA, 155 nt, unidentified
  source 1..155: mol_type = other RNA; note = Related to PBYJ01000041.1; note = Oceanospirillaceae bacterium
gctctttagcgttggactgcttaagtctagtcgggtgattagccagactctaacttattgaacgggtttagggttgcgaaatgaacgcagcgcagcctaaacctgttcggtttaggctgcgctgcgttcatttcgcggcctcttagtgaagagct

SEQ ID NO: 16918 - RNA, 155 nt, unidentified
  source 1..155: mol_type = other RNA; note = Related to NZ_FTMN01000018.1; note = Marinobacterium stanieri
gctctttagtgttggactgtacaagtctagtcgggtgattagccagactctaacttattgaacgggtttagggttgcgaaatgaacgcagcgcagcctaaacctgttcggtttaggctgcgctgcgttcatttcgcggcctcttagtaaagagcg

SEQ ID NO: 16919 - RNA, 146 nt, unidentified
  source 1..146: mol_type = other RNA; note = Related to NZ_WHZZ01000002.1; note = Photorhabdus khanii
actctttagcgttggacgtattacgtctagtcgggtgattagccagactctaacttattgaacgtatttagggttgcgaaagtgtcgcacccctcactcgttcctccttcgggttgcgacactttcgcttcctctagtaaagagtt

SEQ ID NO: 16920 - RNA, 146 nt, unidentified
  source 1..146: mol_type = other RNA; note = Related to NZ_JAFBFW010000005.1; note = Pantoea coffeiphila
actctttagcgttggacgtattacgtctagtcgggtgattagccagactctaacttattgaacgtatttggggttgcgaaagtgtcgcaaccctcactcgttcctccttcgggttgcgacactttcgcttcctttagtaaagagtt

SEQ ID NO: 16921 - RNA, 145 nt, unidentified
  source 1..145: mol_type = other RNA; note = Related to NZ_LMLK01000022.1; note = Erwinia sp.
actctttagcgtggacgtattacgtctagtcgggtgattagccagactctaacttattgaacgcatttggggttgcgaaagtgtcgcacccctcactcgttcctccctcgggttgcgacactttcgcttcctccagtaaagagtt

SEQ ID NO: 16922 - RNA, 146 nt, unidentified
  source 1..146: mol_type = other RNA; note = Related to DAFWUX010000006.1; note = Klebsiella variicola
actctttagcgttggacggctttcgtctagtcgggtgtttagccagactctaatttattgagcgtatttggggttgcgaaagtgtcgcacccctcgctcgttcctccctcgggttgcgacactttcgcttcctccagtaaagagtt

SEQ ID NO: 16923 - RNA, 146 nt, Citrobacter sp.
  source 1..146: mol_type = other RNA; note = Related to UFVV01000001.1; note = Citrobacter koseri
actctttagcgttgggcgttttacgtctagtcgggtgattagccagactctaacttattgagcgaatttggggttgcgaaagtgtcgcccccctcactcgttcctccctcgggttgcgacactttcgcttcctccagtaaagagtg

SEQ ID NO: 16924 - RNA, 146 nt, unidentified
  source 1..146: mol_type = other RNA; note = Related to NSCM01000023.1; note = Photorhabdus bodei
actctttagcgttggacgtcttacgtctagtcgggtgattagccagactctaacttattgaacgcattaagggttgcgaaagtgtcgcaacctgaactcgttcctccttcaggttgcgacactttcgcttcctccagtaaagagcc

SEQ ID NO: 16925 - RNA, 145 nt, unidentified
  source 1..145: mol_type = other RNA; note = Related to NZ_JXSK01000003.1; note = Photorhabdus luminescens
actctttagcgttggacgtttacgtctagtcgggtgattagccagactctaacttattgaacgcattaagggttgcgaaagtgtcgcaaccctctctcgttcctccctcgggttgcgacactttcgcttcctctagtaaagagtc

SEQ ID NO: 16926 - RNA, 145 nt, Citrobacter sp.
  source 1..145: mol_type = other RNA; note = Related to CP047307.1; note = Citrobacter freundii
actctttagcgttggacggtaacgtctagtcgggtgattagccagactctaacttattgaacgtattaagggttgcgaaagtgtcgcaacccgagatcgttcctctctcgggttgcgacactttcgcttcctctagtaaagagtg

SEQ ID NO: 16927 - RNA, 146 nt, unidentified
  source 1..146: mol_type = other RNA; note = Related to NZ_CP023467.1; note = Dickeya dadantii
gctctttagtgttggacgtattacgtcttgtcgggtgattagccagacactaatttattgaacgtatttagggttgcgaaagtgtcgcaacctgaattcgttcctccttcaggttgcgacactttcgcttcctctagtaaagagtc

SEQ ID NO: 16928 - RNA, 146 nt, unidentified
  source 1..146: mol_type = other RNA; note = Related to NZ_DF820431.1; note = Serratia liquefaciens
gctctttagtgttggacgtattacgtcttgtcgggtgattagccagacactaatttattgaacgtatttagggttgcgaaagtgtcgcaacctgaactcgttcctccttcaggttgcgacactttcgcttcctctagtaaagagtg

SEQ ID NO: 16929 - RNA, 146 nt, Aeromonas sp.
  source 1..146: mol_type = other RNA; note = Related to NZ_CDDH01000001.1; note = Aeromonas australiensis
gctctttagcgttggacgtattacgtcttgtcgggtgattagccagacaccaatttattgagcgtttttagggttgcgaaagtgtcgcaacccgaactcgttcctccttcaggttgcgacactttcgcttcctctagtaaagagtt

SEQ ID NO: 16930 - RNA, 146 nt, unidentified
  source 1..146: mol_type = other RNA; note = Related to JAGTSE010000026.1; note = Proteobacteria bacterium
gctctttagtgttggacgtattacgtcttgtcgggtgattagccagacactaatttattgaacgcatttagggttgcgaaagtgccgcaacctgaactcgttcctccttcaggttgcggcactttcgcttcctctagtaaagagtc

SEQ ID NO: 16931 - RNA, 147 nt, Proteus sp.
  source 1..147: mol_type = other RNA; note = Related to CVRY01000004.1; note = Proteus penneri
actctttagcgtaggacatattatgtcttgtcgggtgattagccagacactaatttattgctcacatttagggttgcgaaagtatcgcaacctgatctcgcgagctccttcaggttgcgatactttcgcttcttctagtaaagagta

SEQ ID NO: 16932 - RNA, 187 nt, unidentified
  source 1..187: mol_type = other RNA; note = Related to NZ_WOBT01000016.1; note = Aliivibrio fischeri
gctctttagcttatgacgaacacgtctagtcgggtgattagccagactctaacttattgaacggttttagttgcgaaatgtacgtatttcttcnnnnnnnnnnnnnnnnnnnnnnnnnnnnnnnnnnnnnnnnnnnnnnnnnnnnnnngaagaaatacgtacatttcgctgtctctagtaaagagct

SEQ ID NO: 16933 - RNA, 164 nt, Vibrio sp.
  source 1..164: mol_type = other RNA; note = Related to NZ_LT960611.1; note = Vibrio tapetis
gctctttagcttaagacgaattacgtctagtcgggtgattagccagactctaacttattgaacgggattggttgcgaaatgtacttacttcttcgcgatccaaactcgttcctcctttagaccgcgaagaagtaagtacatttcgctgtctctagtaaagagct

SEQ ID NO: 16934 - RNA, 161 nt, Vibrio sp.
  source 1..161: mol_type = other RNA; note = Related to BGNF01000084.1; note = Vibrio harveyi
gctctttagcttaagacgaacacgtctagtcgggtgattagccagactctaacttattgaacggttttagttgcgaaatgtacgtacttcttcgcagccaaactcgttcctcatttgactgcgaagaagtacgtacatttcgctgtctctagtaaagagct

SEQ ID NO: 16935 - RNA, 164 nt, Vibrio sp.
  source 1..164: mol_type = other RNA; note = Related to NZ_CP045070.1; note = Vibrio harveyi
gctctttagcttaggacgaattacgtctagtcgggtgattagccagactctaacttattgaacgagattagttgcgaaatgtacttacttcttcgctgcctaaactcgttcctcctttaggcagcgaagaagtaagtacatttcgctgtctctagtaaagagct

SEQ ID NO: 16936 - RNA, 164 nt, Vibrio sp.
  source 1..164: mol_type = other RNA; note = Related to NZ_CP009264.1; note = Vibrio coralliilyticus
gctctttagcttaggacgaattacgtctagtcgggtgattagccagactctaacttattgaacgggattagttgcgaaatgtagttacttcttcgcggtctaaactcgttcctcctttagaccgcgaagaagtaactacatttcgctgtctctagtaaagagct

SEQ ID NO: 16937 - RNA, 165 nt, Vibrio sp.
  source 1..165: mol_type = other RNA; note = Related to NZ_CP027030.1; note = Vibrio vulnificus
gctctttagcttaggacgaatttcgtctagtcgggtgattagccagactctaacttattgaacgggattgggttgcgaaatgctcgtacatcttcgcagcctagactcgttcctcccttaggctgcgaagatgtacgagcatttcgctgtctctagtaaagagct

SEQ ID NO: 16938 - RNA, 164 nt, unidentified
  source 1..164: mol_type = other RNA; note = Related to NZ_CP080413.1; note = Shewanella sp.
gctctttagcttaggacgaatttcgtctagtcgggtgattagccagactctaacttattgaacgggaatggttgcgaaatgttcgtacttcttcgcaccctaaactcgttcctcctttaggctgcgaagaagtacgaacatttcgctgtctctagtaaagagct

SEQ ID NO: 16939 - RNA, 143 nt, unidentified
  source 1..143: mol_type = other RNA; note = Related to NZ_LS483250.1; note = Moritella yayanosii
gctctttagcgtaagacgatttcgtctagtcgggtggttagccagactctaatttattgaacgtatttggttgcgaaatattcgcagcataaactcgttcctcctttaggccgcgaacatatcgctgtctctagtaaagagtt

SEQ ID NO: 16940 - RNA, 144 nt, Vibrio sp.
  source 1..144: mol_type = other RNA; note = Related to DACQYM010000007.1; note = Vibrio vulnificus
gctctttagctaatgacgaacatcgtctagtcgggtggttagccagactcaaatttattgaacggttttcgatgcttggtatacgcatcctaaactcgttcctcctttaggatgcgtataccaagcacccttaagtaaagagtt

SEQ ID NO: 16941 - RNA, 144 nt, Vibrio sp.
  source 1..144: mol_type = other RNA; note = Related to PIFQ01000001.1; note = Vibrio splendidus
gctctttagcttatgacgaatttcgtctagtcgggtgattagccagactcaaatttattgaacgggtttcgatgctgtgtacacacatcccaaactcgttcctcctttaggatgcatgtacacagcacccttaagtaaagagtt

SEQ ID NO: 16942 - RNA, 143 nt, Enterobacter cloacae
  source 1..143: mol_type = other RNA; note = Related to JAKMJP010000001.1
tgtctttagcgtaaacgggttacaatgtcgggtggttagccagactctaatttattgaacgagttacacgtgcgatgtgttcgcatcccaaactcgttgcctcgtttgggatgcgaacacatcgcaaaccttagtaaagattc

SEQ ID NO: 16943 - RNA, 143 nt, Enterobacter sp.
  source 1..143: mol_type = other RNA; note = Related to JAJCXF010000001.1
agtctttagcgtaaacgagttacaatgtcgggtgtttagccagactctaatttattgaacgagttacacgtgcgatgtgttcgcatcccaaactcgttgcctcgtttgggatgcgaacacatcgcaaaccttagtaaagattc

SEQ ID NO: 16944 - RNA, 145 nt, Vibrio sp.
  source 1..145: mol_type = other RNA; note = Related to JAKEUX010000006.1; note = Vibrio brasiliensis
gctctttagtgttttgacggactttgtctagtcgggtgtttagccagactctaacttattgaacgagtttacatgcgatgtgtacgcatccaaaactcgttcctcgtttcggatgcgtacacatcgcaccctttagtaaagagct

SEQ ID NO: 16945 - RNA, 147 nt, unidentified
  source 1..147: mol_type = other RNA; note = Related to NZ_CAKODS010000001.1; note = Kosakonia cowanii
gctctttagcgtaaaacgagttaaacattgtcgggtgattagccagacactaacttattgaacgagttaaatttgcgatgcattcacatcccaaactcgtctcgctcgtttaggatgcgaacgcatcgcaccctttagtaaagagcg

SEQ ID NO: 16946 - RNA, 146 nt, Citrobacter sp.
  source 1..146: mol_type = other RNA; note = Related to JAASMA010000001.1; note = Citrobacter koseri
gctctttagcgtaaacgggttacaacttgtcgggtgattagccagacactaacttattgaacgagttaaatttgcgatgtattcgcatcccaaactcgtttcgctcgtttgggatgcgaacacatcgcaccctttagtaaagagtc

SEQ ID NO: 16947 - RNA, 148 nt, Vibrio sp.
  source 1..148: mol_type = other RNA; note = Related to MCZP01000152.1; note = Vibrio breoganii
gctctttagcgtaaacgagattcaaaatagtcgggtgtttagccagactctaacttattgaacgggttatattgcggtgtgttcacatcccaaactcgctctcgctcgtttgggatgcaaacacaccgcaaccctttagttaagagta

SEQ ID NO: 16948 - RNA, 137 nt, Vibrio parahaemolyticus
  source 1..137: mol_type = other RNA; note = Related to NZ_QPQH01000001.1
gctctttagcgtttttatattagtcgggtgattagccagactctaacttattgaacgggtttgcatgcgctgtacacgcatcccaaactcgttcctcgtttgggatgcgtgtacaccgcaccctctagtaaagagct

SEQ ID NO: 16949 - RNA, 136 nt, Vibrio sp.
  source 1..136: mol_type = other RNA; note = Related to NZ_SZZR01000017.1; note = Vibrio gallaecicus
gctctttagcgttttaatatagtcgggtgtttagccagactctaacttattgaacgggtttgcatgcgttgtaaacgcatcccaaactcgttcctcatttgggatgcatctacaacgcacccttaagtaaagagca

SEQ ID NO: 16950 - RNA, 136 nt, Vibrio sp.
  source 1..136: mol_type = other RNA; note = Related to BBSA01000008.1; note = Vibrio ishigakensis
atcctttagcgttttagaatagtcgggtgcttagccagactctaacttattgagtgggtttgaatgcgatgtgtacgcatctcaaactcgttcctcatttgagatgcgtacacatcgcacctttaagtaaaggatt

SEQ ID NO: 16951 - RNA, 140 nt, Vibrio sp.
  source 1..140: mol_type = other RNA; note = Related to MCXQ01000034.1; note = Vibrio lentus
actctttagcttaggacgaatttcgtctagtcgggtgtttagccagactctaacttattgggcactttatgattgcgaaaggtatctttgttcgcnnnnnngcgaacaaagatacctttcgcttcttttagtaaagagtt

SEQ ID NO: 16952 - RNA, 163 nt, Vibrio sp.
  source 1..163: mol_type = other RNA; note = Related to NZ_CP025953.1; note = Vibrio campbellii
actctttagcttagggcgaatttcgtctagtcgggtgattagccagactctaacttattgggcactttatgattgcgaaaggtatctttgttcgcttcatagagctcgtccctcactttatgaagcgaacaaagatacctttcgcttcttttagtaaagagtt

SEQ ID NO: 16953 - RNA, 145 nt, unidentified
  source 1..145: mol_type = other RNA; note = Related to NZ_LOFH01000001.1; note = Pseudoalteromonas sp.
gtcttttagcgaatgaggcatttatgcctagtcgggtgtttagccagactctaacttattgaacgagattgtatgcgatatctgcgcatacaaagctcgttcctcactttgtatgcgcagatatcgcattaactagtaaaagaca

SEQ ID NO: 16954 - RNA, 144 nt, Aeromonas hydrophila
  source 1..144: mol_type = other RNA; note = Related to CP000462.1
gctctttagcttgagacgttttcgtcaagtcgggtgattagccagactcaaatttattgggcggtttaaggttgcgaaaggtccgcgccctaaactcgtacctcctttagggcgcgaacctttcgcctcctgtagtaaagagtc

SEQ ID NO: 16955 - RNA, 143 nt, Citrobacter sp.
  source 1..143: mol_type = other RNA; note = Related to DACSXM010000001.1; note = Citrobacter freundii
actctttagctttggacggattcgtctagtcgggtgattagccagactcaaaattattgaacgggtttaaaagcgatgtatacgcatcctaaactcgttcctcctttaggatgcgtatacatcgcattcttaagtaaagagct

SEQ ID NO: 16956 - RNA, 143 nt, unidentified
  source 1..143: mol_type = other RNA; note = Related to NZ_CP090245.1; note = Klebsiella oxytoca
actctttagctttggacgttttcgtctagtcgggtgattagccagactcaaaattattgaacgggtttaaatgcgatgtatacgcatcctaaactcgttcctcctttaggatgcgtatacatcgcattctcaagtaaagagct

SEQ ID NO: 16957 - RNA, 141 nt, unidentified
  source 1..141: mol_type = other RNA; note = Related to NZ_JABEBB010000004.1; note = Pantoea ananatis
actctttagcgtggacgttacgtctagtcgggtgttcagccagactcaaatttattgaacgggtttaaatgcaatgtatacgcatcttaaactcgttcctcctttaagatgcgtatacattgcattctttagtaaagagtc

SEQ ID NO: 16958 - RNA, 145 nt, unidentified
  source 1..145: mol_type = other RNA; note = Related to JACGVM010000019.1; note = Colwellia sp.
actctttagcttcggacaaaatttgtctagtcgggtgattagccagactctaatttattgaacgggtttatatgcgatatacatgcatcctaaactcgtacctcctttaggatgcatgcataccgcattctttaagtaaagagtg

SEQ ID NO: 16959 - RNA, 144 nt, unidentified
  source 1..144: mol_type = other RNA; note = Related to NZ_CP016181.1; note = Marinomonas primoryensis
gctctttagcttaggacgttttcgtctagtcgggtgttaagccagactctaatttattgaacgggatatggttgcgcggcaagcgcaacctagactcgttcctcgcttaggttgcgcttgccgcgcttcctctagtaaagagtg

SEQ ID NO: 16960 - RNA, 148 nt, unidentified
  source 1..148: mol_type = other RNA; note = Related to MEIT01000084.1; note = Snodgrassella alvi
aatctttagcgatatggactttattgtctagtctggtgtttagccggactcaaatttattgtgtggatttcggttgcgaaagaatcagttcctaaccccgattatcgtgcttagtaactgattctttcgcgtcctttagtaaagattg

SEQ ID NO: 16961 - RNA, 147 nt, unidentified
  source 1..147: mol_type = other RNA; note = Related to MEIK01000040.1; note = Snodgrassella alvi
aatctttagcgatacggacgtaattgtctagtctggtgcttagccggactctaatttattgagtggaattggttgcgaaagaatcagtttctaatcccgattctcggtctcagaaactgcttctttcgcgttctttagtaaagattg

SEQ ID NO: 16962 - RNA, 132 nt, unidentified
  source 1..132: mol_type = other RNA; note = Related to CP091515.1; note = Snodgrassella alvi
aatctttagcgttacagactttattgtctagtctggtgtttagccggactcaaatttattgtgtggatttggttgcgaaataaccagtttctcattcgaaactgtttatttcgcttcctttagtaaagatta

SEQ ID NO: 16963 - RNA, 142 nt, Enterobacter cloacae
  source 1..142: mol_type = other RNA; note = Related to CP010512.1
gttctctagcttggcaatcttgccttgtcgggtgtttagccagacactaagttattgaacgagtttgcatgcggtgtgtacgcattccaaactcgttccctcatttggaatgcgtacacaccgcattctcaagtagagaacg

SEQ ID NO: 16964 - RNA, 142 nt, Citrobacter sp.
  source 1..142: mol_type = other RNA; note = Related to DACSVK010000003.1; note = Citrobacter freundii
gctctttagcttgacgttttacgtcttgtctggtgatcagccagacactaagttattgaacgagtttacatgcggtatgtacgcattccaaactcgttcctcctttggaatgcgtacataccgcatcctctagtaaagagct

SEQ ID NO: 16965 - RNA, 160 nt, Acinetobacter sp.
  source 1..160: mol_type = other RNA; note = Related to JALGBR010000010.1
actctttagcttttaggacttaacaagtctagtcgggtgtttagccagactctaatttattgactgcatttgaagaacaaaagtttaaattgttcgctcatatgtttgctcacgcacatattcgcaaacaattgaaacttttgctctatagtaaagagta

SEQ ID NO: 16966 - RNA, 158 nt, Acinetobacter sp.
  source 1..158: mol_type = other RNA; note = Related to VYTC01000001.1; note = Acinetobacter junii
gctctttagctttaagacgtaaccgtctagtcgggtgtttagccagactctaatttattgattgcatttgcagaacaaaagtttaaattgttcgctcacatgtttgcttacgcacatattcgcaaacaattgaaacttttgctctatagtaaagagta

SEQ ID NO: 16967 - RNA, 146 nt, Acinetobacter sp.
  source 1..146: mol_type = other RNA; note = Related to KB851203.1; note = Acinetobacter seifertii
gctctttagcttttaggacttaacaagtctagtcgggtgtttagccagactctaatttattgaccacatttggagaacaaaagtttcaattcttcgctcatgcgaattcgcaaacaattgaaacttttgctctaaagtaaagagta

SEQ ID NO: 16968 - RNA, 152 nt, Acinetobacter sp.
  source 1..152: mol_type = other RNA; note = Related to NZ_PYIX02000002.1; note = Acinetobacter sichuanensis
gctctttagctttaggacttaacagtctagtcgggtgtttagccagactctaacttattgatgaaactcattgcaatactgcagacctaaagtttcaattcttcgctcggttctcgcaaacaattgaaactttagctctaaagtaaagagta

SEQ ID NO: 16969 - RNA, 153 nt, Acinetobacter sp.
  source 1..153: mol_type = other RNA; note = Related to LSZI01000016.1
gctctttagctttaggacttaacagtctagtcgggtgtttagccagactctaatttattgaccacatttggagaacaaaagtttaaattgttcgctcatttgctatgcgctcattcgcaaacaattgaaacttttgctctgaagtaaagagta

SEQ ID NO: 16970 - RNA, 146 nt, Acinetobacter sp.
  source 1..146: mol_type = other RNA; note = Related to CP031984.1; note = Acinetobacter haemolyticus
gctctttagctttaggacttaaccgtctagtcgggtgtttagccagactctaacttattgatgaatcacattgaagaacaaaagtttaaattgttcgctcacgttgttcgcaaacaattgaaacttttgctcttaagtaaagagta

SEQ ID NO: 16971 - RNA, 146 nt, Acinetobacter sp.
  source 1..146: mol_type = other RNA; note = Related to NZ_VPEY01000001.1
gctctttagctttgggacttaacagtctagtcgggtgtttagccagactctaacttattgatgaaacacattggagaacaaaagtttcaattcttcgctcatgtgattcgcaaacaattgaaacttttgctctaaagtaaagagcg

SEQ ID NO: 16972 - RNA, 141 nt, Acinetobacter sp.
  source 1..141: mol_type = other RNA; note = Related to CP018254.1; note = Acinetobacter baumannii
gctctttagttttaggacgtaacagtctagtcgggtgtatagccagactccaacttattgatgtttttgtgaatcagaagttttactacttcgctcatatcttcgcaaactattaaaacttctgctcattagtaaagagta

SEQ ID NO: 16973 - RNA, 141 nt, Acinetobacter sp.
  source 1..141: mol_type = other RNA; note = Related to DADATW010000032.1; note = Acinetobacter baumannii
gctctttagttctaggacgtaacagtctagtcgggtgtatagccagactccaacttattgatgttattgtgaatcagaagttttactacttcgctcatatcttcgcaaactactaaaacttctgctcattagtaaagagta

SEQ ID NO: 16974 - RNA, 148 nt, Acinetobacter sp.
  source 1..148: mol_type = other RNA; note = Related to CP009256.1; note = Acinetobacter baumannii
actctttagcttttgacttttactggtcaagtcgggtgctaagccagactctaatttattgcgtacactttaggttgcgaaacaacagcatcctaaattgcgtagcctcatttaggatgctgttgttccgcctccttagtaaagagtt

SEQ ID NO: 16975 - RNA, 148 nt, Acinetobacter sp.
  source 1..148: mol_type = other RNA; note = Related to NZ_CP090180.1; note = Acinetobacter johnsonii
actctttagcttatgacttttaccagtcaagtcgggtgttaagccagactctaacttattgcgtacactttaggttgcgaaactacagcatcctaaattacgtagcctcatttaggatgctgtagttccgcctcctgtgtaaagagtt

SEQ ID NO: 16976 - RNA, 136 nt, unidentified
  source 1..136: mol_type = other RNA; note = Related to NZ_GL883764.1; note = Parasutterella excrementihominis
gcttcttagcgtttaatagattaagtcgggtgttaagccagattgaattttcctgttggcattggagcggcctctcgccgccttaatgcctgataacagccaataaagcggcgagaggccgtctctagtaaggagc

SEQ ID NO: 16977 - RNA, 158 nt, Acinetobacter sp.
  source 1..158: mol_type = other RNA; note = Related to NZ_CP083989.1; note = Acinetobacter guillouiae
gctctttagctatgggttctatgagcctagtcgggtgttaagccagactcaaatttattgggaacattgagcgttgcgaaaggtatatacctttcgcttacatgctttcacatgttcacaaaaggtatatacctttcgcttcgtatgagtagagagta

SEQ ID NO: 16978 - RNA, 157 nt, Acinetobacter sp.
  source 1..157: mol_type = other RNA; note = Related to KI530706.1; note = Acinetobacter gyllenbergii
gctctttagttatgggttctatgggcctagtcgggtgttaagccagactcaaatttattgagagcattgagcgttgcgaaaggtagatacctttcgctcaatgttcgcacatattcgcaaaaggtatctacctttcgcttcgtatgagtagagagta

SEQ ID NO: 16979 - RNA, 160 nt, Acinetobacter sp.
  source 1..160: mol_type = other RNA; note = Related to NZ_MABW01000006.1; note = Acinetobacter baumannii
gctctttagctatgggttcatagagcctagtcgggtgttaagccagactcaaacttattgggagcattgagcgttgcgaaaggtataaacctttcgctcacatgttcctgtacatgttcgcaaaaggtttatacctttcgcttcgtatgagtaaagagca

SEQ ID NO: 16980 - RNA, 151 nt, Acinetobacter sp.
  source 1..151: mol_type = other RNA; note = Related to LWHP01000001.1; note = Acinetobacter pittii
gctctttagctttaggactttttgagtccggtcgggtgttaagccagaccctaatttattgattgccatggcgttgcgaaagtagagatacttccgctgcgcttacgcttacagaagtatctctactttcgctgcgtgtgagtaaagagca

SEQ ID NO: 16981 - RNA, 183 nt, Vibrio sp.
  source 1..183: mol_type = other RNA; note = Related to QJUD01000001.1; note = Vibrio furnissii
gctctttagtgttaatttggattgaattttcagtagtttaatctagtttggcgatgcgctaaactctcatttattgggcagatttgcagttgcggaacaagattttagacccgcaaccgctgctcatccttcgcagacgcttgcggatctaaaatcttgttccgcggcttcgagtaaagagct

SEQ ID NO: 16982 - RNA, 181 nt, Vibrio sp.
  source 1..181: mol_type = other RNA; note = Related to SYUN01000005.1; note = Vibrio kanaloae
gctctttagtgtaatttagattgaatttcaaaagtttagtctagtctggcgatgcgccaaactctcatttattgggcacatttgcagttgcggaacaacattttagacccgtaaccgctgctcatgcttcacagacgcttacggatctaaaatgttattccgcggcttctagtaaagagct

SEQ ID NO: 16983 - RNA, 180 nt, unidentified
  source 1..180: mol_type = other RNA; note = Related to PYNL01000004.1; note = Photobacterium kishitanii
gctctttagcgtaattttgattagataaatctatttaatcttgtttggcgttgcgccaaacactcatttattgggcagatttacagttgcggaacaagatttttgagccgcaatcactgctcatccttcacagatgcttacggatcaaaaatcttgttccgcggctaaaagtaaagagct

SEQ ID NO: 16984 - RNA, 181 nt, unidentified
  source 1..181: mol_type = other RNA; note = Related to JABAIP010000015.1; note = Shewanella sp.
gctctttagtgttattaggattaactctatgatgtttaatctagtttggtgttgcgccaaactctaatttattgggcagatttacagttgcggaacaacatttttgagccgcaaccgctgctcatccttcgcagacgcttacggatcaaaaatgttgttccgcggctttaagtaaagagca

SEQ ID NO: 16985 - RNA, 181 nt, Vibrio sp.
  source 1..181: mol_type = other RNA; note = Related to CAOA01000025.1; note = Vibrio nigripulchritudo
gctctttagcgtaatttagattagataatgttgatttaatctagtttggcgttgcgccaaactctaacttattgggcagttttacagttgcggaactaaatttttgagccgcaaccgctgctcattcttcacagacgcttacggatcaaaaatttagttccgcggcttctagtaaagagct

SEQ ID NO: 16986 - RNA, 183 nt, unidentified
  source 1..183: mol_type = other RNA; note = Related to NZ_FNXF01000018.1; note = Rheinheimera pacifica
gctctttagtgttttcaggattagtcctgcaaggattgatctagttcggcgttgcgccgaactctaaattattgggcagatttgcggttgcggaacaaaatttttgagcctcaattcgtagttcgtccctcacttcgcctttcggatcaaaaattttgttccgcggctaactagtaaagagcg

SEQ ID NO: 16987 - RNA, 184 nt, unidentified
  source 1..184: mol_type = other RNA; note = Related to NZ_AXWP01000001.1; note = Psychromonas arctica
actctttagcgttttttggattaaattcaaatgctttaatctagtttggcgttgcgccaaactctaacttattgagcatatttatagttgcggaacaaaatttctgaaccgcaatacgttgctcatacttcacatccgcttacggatcagaaatgttgttccgctagcttctaggtaaagagtc

SEQ ID NO: 16988 - RNA, 182 nt, unidentified
  source 1..182: mol_type = other RNA; note = Related to JADYXL010000005.1; note = Pseudoalteromonas sp.
gcactttagcgttattttggttagatattaaatatttaatctagtttggcgatgcgccgaactctaatttattgagtacattcaaagttgcgaaataaaactcctgaactgcaatccgttgttcgtacctcacagccgtttgcagatcaggagtttgattccgcgtctactagtaaagggca

SEQ ID NO: 16989 - RNA, 168 nt, unidentified
  source 1..168: mol_type = other RNA; note = Related to CP015750.1; note = Pectobacterium wasabiae
gctctttagcgtattgtggatttaccatgtttttggtcaaatctagttgggcgttgcgccgaactctaatttattgattacatttacagttgcggaacaaactttttgagccgcaatccagtaggttgcggatcaaaaagtttgttccgcggctacaagtaaagagcc

SEQ ID NO: 16990 - RNA, 168 nt, unidentified
  source 1..168: mol_type = other RNA; note = Related to DAFWTN010000002.1; note = Klebsiella quasipneumoniae
gctctttagcgtattatggatttaccacctgattggtcaaatctagttgggcgttgcgccaaactctaatttattgattacatttacagttgcggaacaaactttttgagccgcaatccagtaggttgcggatcaaaaagtttgttccgcggcttcaagtaaagagcc

SEQ ID NO: 16991 - RNA, 164 nt, unidentified
  source 1..164: mol_type = other RNA; note = Related to UGYN01000002.1; note = Serratia quinivorans
gctctttagcgtagtatgggttttaccattgaaggttaaatctagtttggcgatgcgctgaactctaacttattgattacatttacagttgcggaacaacatttctgagccgcagccgtagttgcggatcagaaatgttgttccgcggcttctagtaaagagca

SEQ ID NO: 16992 - RNA, 171 nt, unidentified
  source 1..171: mol_type = other RNA; note = Related to JAGJEM010000002.1; note = Pseudoalteromonas luteoviolacea
gctctttagcgtaatttggattagttttaatctagtttgatgatgcgtcaaactcaaatttattgagcaatattctgcgctgcggaaagaaattttcgatccgcagttcttgctcatccttcgcaaaactgcggatcaaaaatttccttccgcggcgactagtaaagagca

SEQ ID NO: 16993 - RNA, 179 nt, unidentified
  source 1..179: mol_type = other RNA; note = Related to NZ_NBOE01000008.1; note = Colwellia polaris
gctctttagtgtatttttgattgaatttaatggtttaatctagtttggcgttgcgccaaactcaaatttattgagtacatttacagttgcgaaatcaaattattgatccgtgatatgtactcatacttcgcacagataacggatcaataatttgattccgcgtctttaagtaaagagta

SEQ ID NO: 16994 - RNA, 178 nt, Vibrio parahaemolyticus
  source 1..178: mol_type = other RNA; note = Related to NNIR01000014.1
gctctttagcgtaatttggattaagtttatgatttaatctagtttggcgttgcgccgaactctaatttattgagtggttttgcagctgcggaacggcatttccgaactgcaatagttactcattcttcgcaacgattgcagatcggaaatgccgctccgcgtctttaagtaaagagct

SEQ ID NO: 16995 - RNA, 178 nt, unidentified
  source 1..178: mol_type = other RNA; note = Related to SEZJ01000011.1; note = Aliivibrio finisterrensis
gctctttagcgtaatttggattgaatttatgatttaatctagtctggcgttgcgccaaactctaatttattgagtggttttgcagctgcggaacaatatttccgaactgcaatcgtcactcattcttcgcaacgattgcagatcggaaataccgttccgcgtctttaagtaaagagct

SEQ ID NO: 16996 - RNA, 179 nt, Vibrio sp.
  source 1..179: mol_type = other RNA; note = Related to JAKEVQ010000003.1; note = Vibrio brasiliensis
gctctttagcgtaatttggattaagcttagtgttttaatctagtttggcgttgcgccaaactctaatttattgagtgcttttgcagctgcggaacggcattcccgatctgcaatagttactcattcttcgcaacgattacagatcggaaatgccgatccgcgtctttaagtaaagagct

SEQ ID NO: 16997 - RNA, 178 nt, Vibrio sp.
  source 1..178: mol_type = other RNA; note = Related to PIZL01000016.1
gctctttagcgtaatttggattaatcttacgatttaatctagtttggcgttgcgccaaactctaatttattgagtggttttgcagctgcggaacggtatttccgaactgcaatagttactcattcttcgcaacgattgcagatcggaaataccgctccgcgtcttttagtaaagagct

SEQ ID NO: 16998 - RNA, 179 nt, unidentified
  source 1..179: mol_type = other RNA; note = Related to JAEFCD010000023.1; note = Alteromonas sp.
gctctttagcgtaatttggattagatcttgtaatttaatctagtttggcgttgcgccaaactcaaatttattgagtagttttacggttgcggaacgacattatcgatccgcaatagttgctcattcttcgcaccgattgcggatcgataatgtcgttccgcgtctcaaagtaaagagta

SEQ ID NO: 16999 - RNA, 179 nt, Vibrio sp.
  source 1..179: mol_type = other RNA; note = Related to VTYC01000009.1
gctctttagcgtaatttggattagatttattgatttaatctagtttggcgttgcgccaaactctaacttattgagtaattttacagttgcggaacgacattatcgatccgtgatagttactcattcttcgcaacgatcacggatcgataatgtcgttccgcgtcttaaagtaaagagtc

SEQ ID NO: 17000 - RNA, 179 nt, unidentified
  source 1..179: mol_type = other RNA; note = Related to WMDD01000002.1; note = Photobacterium carnosum
actctttagcgtaatttggattaaatttataggtttaatctagtttggcgttgcgccaaactctaatttattgagtagttttacagttgcggatcgaaattttcgaaccgtaatagttactcattcttcgtaccgattacggatcgaaaatttcgctccgcgtctttaagtaaagagtt

SEQ ID NO: 17001 - RNA, 174 nt, unidentified
  source 1..174: mol_type = other RNA; note = Related to JADZHL010000041.1; note = Shewanella algae
gctctttagcgttatacggattaggtactacttagtctagtttggcgatgcgccaaactctaacttattgagggcattcacagttgcggaacaacatttttgaaccgcagttgtttactccctcgtaaaaactgcggttcaaaaatgttgttccgctgcttctagtaaagagca

SEQ ID NO: 17002 - RNA, 178 nt, unidentified
  source 1..178: mol_type = other RNA; note = Idiomarinaceae bacterium; note = Related to PAZB01000040.1
gctctttagcgtatgttggattagactgttatgggtttgatctagtttggcgatgcgccgaactctaatttattgagcacttttagagttgcggaactaaagtttagaaccgctccttcactcggtgctcgcgcgccacggttctaaactttagttccgcggcttcaagtaaagagca

SEQ ID NO: 17003 - RNA, 152 nt, unidentified
  source 1..152: mol_type = other RNA; note = Related to NZ_CP054160.2; note = Serratia fonticola
gctctttagcgtatggacggtttttgcgtctagtcgggcggttagccagactctaacttattgagcacttttatgattgcgataaacacttcatcgcatcataaagtgttatgatgcgatgaagtgtttatcgcggcttctagtaaagggct

SEQ ID NO: 17004 - RNA, 152 nt, unidentified
  source 1..152: mol_type = other RNA; note = Related to JADTXI010000006.1; note = Serratia ureilytica
gctctttagcgtaaggacgaattatacgtctagtcgggcggttagccagactcaaacttattgagcacttttatgattgcgataaacacttcatcgcatcataaagtgttatgatgcgatgaagtgtttatcgcggcttctggtaaagggcg

SEQ ID NO: 17005 - RNA, 166 nt, unidentified
  source 1..166: mol_type = other RNA; note = Related to CP059036.1; note = Serratia marcescens
gctctttagtgtcggaacaatggttccagccgggtgtttagccaggcgctaatttattgtccatttcaggattgcgaaagacacacacttctccttcgcctatcctgctctgggcagtctatgcgaaggagaagtgcgtgtctttcgctgtctttagtaaagagcg

SEQ ID NO: 17006 - RNA, 166 nt, unidentified
  source 1..166: mol_type = other RNA; note = Related to NZ_JACHAQ010000007.1; note = Pectobacterium brasiliense
gctctttagtgtaggaacaatggttccagccgggtggttagccaggctctaatttattgtccattttagggttgcgaaagacacgcacttctccttcgcatttcctgctttgggcagtctctgcgaaggagaagtgcgtgtctttcgctgtctttagtaaagggca

SEQ ID NO: 17007 - RNA, 166 nt, unidentified
  source 1..166: mol_type = other RNA; note = Related to NZ_LR607333.1; note = Klebsiella aerogenes
gctctttagtgtaggaacaatggttccagccgggtggttagccaggctctaatttattgtccataatagggttgcgaaagacacacacttctccttcgcatatcctgcttatggcagtcaatgcgaaggagaagtgcgtgtctttcgctgtctttagtaaagggca

SEQ ID NO: 17008 - RNA, 137 nt, unidentified
  source 1..137: mol_type = other RNA; note = Related to JACHAS010000001.1; note = Pectobacterium polaris
gctctttagcgtaggaacattggttccagccgggtgattagctaggctctaatttattgtccacatcagggttgcgaaagacacgcacttcgtctnnagacgaagtgcgtgtctttcgctgtctttagtaaagggct

SEQ ID NO: 17009 - RNA, 165 nt, unidentified
  source 1..165: mol_type = other RNA; note = Related to PQJY01000001.1; note = Leclercia sp.
gctctttagcgtaggaacataggttccagccgggtgtttagccaggcttaaatttattgtccagtttagggttgcgaaagacacagagtcctccttcgcatccctggctggtaccagatatgcgaaggaggactctgcgtctttcgctgtctttagtgaagagtc

SEQ ID NO: 17010 - RNA, 164 nt, Escherichia coli
  source 1..164: mol_type = other RNA; note = Related to CP026641.1
gctctttagtgtaggaacattggttccagccgggtgattagccaggcttaaatttattgtccggtttagggttgcgaaagacacagatttctccttcgcatccctgcccggggcagatatgcgaaggagaaatctgtgtctttcgctgtctttagtgaagagtc

SEQ ID NO: 17011 - RNA, 165 nt, Enterobacter sp.
  source 1..165: mol_type = other RNA; note = Related to JAHEUL010000001.1; note = Enterobacter mori
gctctttagtgtaggaacattggttccagccgggcgattagccaggcttaaatttattgtccagtttagggttgcgaaagacacagatttctccttcgcctctctggctggtgccagatatgcgaaggagaaatctgtgtctttcgctgtctttagtgaagagtc

SEQ ID NO: 17012 - RNA, 166 nt, unidentified
  source 1..166: mol_type = other RNA; note = Related to LFJS01000012.1; note = Serratia marcescens
gctctttagcgctatggaccttaattagtggtctagccgggcgtttagccaggctctaacttattgggcacatttggttgcgaaagtaacgcattcgcttcctcgatctccgtgccgtcgttcgtggaagcgaatgcgttactttcgctgtctttagtaaagagct

SEQ ID NO: 17013 - RNA, 160 nt, unidentified
  source 1..160: mol_type = other RNA; note = Related to JACYNT010000005.1; note = Pantoea agglomerans
gctctttagcgaaggacctaagatttggtctagccgggtgtttagccaggctctaatttattgagcacattgaggttgcgaaagtcacgcattcgcttcctcaaacgagtgttcgttctcgaaagcgaatgcgtaactttcgctgtctttagtaaagagc

SEQ ID NO: 17014 - RNA, 171 nt, Escherichia coli
  source 1..171: mol_type = other RNA; note = Related to CP057778.1
gctctttagcgttagggaaccattgcgttctagccgggcgataagccaggctctaatttattgctcagtttagggttgcgaaagcgacgaattccgccttcgcatcctatggctgttgccatagtttacgaaggcggaattcgtcgctttcgctgtctttagtgaagagct

SEQ ID NO: 17015 - RNA, 169 nt, Vibrio sp.
  source 1..169: mol_type = other RNA; note = Related to CP003330.1; note = Vibrio cholerae
gctctttagcgaatggactacacatattagtctagtcgggcgtttagccagactgaaatttattgaacgacactggggttgcgaaatggaggtttttctctcctctcgcatttccctgaactgcgagaggagagaaaaacctccatttcgctgtctctagtaaagagct

SEQ ID NO: 17016 - RNA, 169 nt, Vibrio sp.
  source 1..169: mol_type = other RNA; note = Related to JAHUGH010000003.1; note = Vibrio fluvialis
gctctttagcgtacggactacacaaattagtctagtcgggcgtttagccagactgaaatttattgaacgacactggggttgcgaaatggagatttttctcttctctcgcagttccccaaactgcgagagaagagaaaaatctccatttcgctgtctctagtaaagagct

SEQ ID NO: 17017 - RNA, 179 nt, Vibrio parahaemolyticus
  source 1..179: mol_type = other RNA; note = Related to JACBSQ010000003.1
gctctttagtgcttggactactattattagtctagtcgggcgtttagccagactcaaacttattgaacgacactggggttgcgaaaggtatacaaacatttttcgcagctcttcactcgttcctcataaagatctgcgaaaaatgtttgtacacctttcgctgtctctagtaaagagct

SEQ ID NO: 17018 - RNA, 180 nt, Vibrio sp.
  source 1..180: mol_type = other RNA; note = Related to AAXMKO010000002.1; note = Vibrio alginolyticus
gctctttagtgtttggactatcaaattttagtctagtcgggtgcttagccagactcaaacttattgaacgacactggggttgcgaaagacactcttaagttttccgcatctctctgctcgttcctcacagaaatctgcgaaaaacttaagagtgtctttcgctgtctctagtaaagagct

SEQ ID NO: 17019 - RNA, 178 nt, Vibrio sp.
  source 1..178: mol_type = other RNA; note = Related to MCWW01000053.1; note = Vibrio cyclitrophicus
gctctttagcgtttgggctacctaaaattagtctagtcgggtgtttagccagactcaaatttattgaacgagattggggttgcgaaatgtaccagcaaattttcgcacatccctgctcgttcctcacagaaatttgcgaaaatttgcttgtacatttcgctgtctctagtaaagagct

SEQ ID NO: 17020 - RNA, 141 nt, unidentified
  source 1..141: mol_type = other RNA; note = Related to JACAWH010000114.1; note = Aggregatibacter actinomycetemcomitans
accttttagcgtatgtctacaagttttagttcggtgtttagccgtaacgtatttatattgggcacatatgggttgcgagacaaacgtcaagcaactcaataagttgcttgacgtttgtctcgcttccattagtaaaaggtc

SEQ ID NO: 17021 - RNA, 140 nt, unidentified
  source 1..140: mol_type = other RNA; note = Related to NZ_QEPT01000001.1; note = Haemophilus parainfluenzae
gccttttagtgtatgtctacaagtttagttcggtgtttagccgtaacatgtttatattgggcagatatgggttgcgagacaaatgtcaagcaactcaactagttgcttgacatttgtctcgcttccattagtaaaaggcc

SEQ ID NO: 17022 - RNA, 150 nt, unidentified
  source 1..150: mol_type = other RNA; note = Related to CP069510.1; note = Haemophilus parahaemolyticus
gccttttagcgtatgtctatgaaagcttagctttagttcggtgtttagccgcaacgtatttatattgggcagataagggttgcgagacaaatgtcaagcaactctgaataagttgcttgacatttgtctcgcttccattagtaaaaggtt

SEQ ID NO: 17023 - RNA, 149 nt, unidentified
  source 1..149: mol_type = other RNA; note = Related to NZ_CP060440.1; note = Serratia marcescens
gctctttagcttaggaccaaatcaacggtctagccgggtgtttagccaggctctaatttattgaacgacataaggttgcgaaaggtgcagagcccggccttcgtaccttgtccgggagctgcacctttcgcttcctttagtaaagagtc

SEQ ID NO: 17024 - RNA, 155 nt, Aeromonas sp.
  source 1..155: mol_type = other RNA; note = Related to JAEHHT010000028.1; note = Aeromonas veronii
gctctttagtgtgcagactaacgtgattagtctagtcgggtgtttagccagactctaacttattgaacggatctgaggttgcgaaagcatcgcattcctagatccgcttcgcttgtctaggaatgcgatgctttcgcggcctctagtaaagagca

SEQ ID NO: 17025 - RNA, 167 nt, Vibrio parahaemolyticus
  source 1..167: mol_type = other RNA; note = Related to NNJO01000006.1
gccctttagcgttcggactttatgtcttgtcgggcgataagccagacactaacttattggggaacaattgcggttgcggtgaaaaatcttttctcgcgttctgcaggctcgttcctcaccagcaggtcgcgagaaaagattttccaccgcttcctttagtaaaggga

SEQ ID NO: 17026 - RNA, 165 nt, Vibrio sp.
  source 1..165: mol_type = other RNA; note = Related to PIFK01000090.1; note = Vibrio splendidus
accctttagcgtatggactctatgtcttgtcgggtgctaagccagacactaacttattggggaacaactgcggttgcggtgaaaaatatttcccgcgctctgcctgctcgttcctctcagccaggtcgcgggaaatattttccaccgcttcctttagtaaaggga

SEQ ID NO: 17027 - RNA, 163 nt, unidentified
  source 1..163: mol_type = other RNA; note = Related to NZ_LT897828.1; note = Salinivibrio costicola
accttttagcgtatggacttgatgtcttgtcgggcggttagccagacactaacttattggggagcaattggggttgcggtgaaaaatgtttccgcgacctgtagttcgttcctcactagcaggtcgcggaaacattttccaccgcttccttcagtaaaaggag

SEQ ID NO: 17028 - RNA, 183 nt, Proteus sp.
  source 1..183: mol_type = other RNA; note = Related to NZ_NBUT01000010.1; note = Proteus vulgaris
gttctttagtgttaagacattctctgattaatcaggattagtctagtcgggcgttacgccagactctaatttattgggaaacaattgttgttgcggtgaataaattttaaatccgcaacccaactgtgccacagttagtttgcggatttaaaatttattcaccgctttctttagtaaagaact

SEQ ID NO: 17029 - RNA, 168 nt, unidentified
  source 1..168: mol_type = other RNA; note = Related to NZ_CP011025.1; note = Pseudoalteromonas arctica
atcctttagcgttaagacattatgtctagtcgggcggtacgccagactcaaatttattggggaacatttttggttgcggagaagaacttttctcttcgtatcaattcttcgttcctcagcctagctacgaagagaaaagttcttctccgcttcctttagtaaagggtt

SEQ ID NO: 17030 - RNA, 175 nt, unidentified
  source 1..175: mol_type = other RNA; note = Related to NZ_CP080635.1; note = Shewanella putrefaciens
aacctttagtgtatggactatttagtctagtcgggcgctaagccagactctaacttattgggacacatttttggttgcgggaagggaaatatccatttccaccgccaatcgttcgtccctcacgctcggcagcggaaatggatatttctcttcccgcttcctttagtaaaggtgt

SEQ ID NO: 17031 - RNA, 163 nt, unidentified
  source 1..163: mol_type = other RNA; note = Related to NZ_PYMJ01000011.1; note = Photobacterium frigidiphilum
atcctttagtttatagacattaagtctagtcgggcgataagccagactctaatttattggggagttctgcgattgcggtgtaaattttatccgcgttcgctcaacgagttcctcgtttctcggtcgcggataaaatctacaccgcttccttaagtgaaggatt

SEQ ID NO: 17032 - RNA, 163 nt, Vibrio sp.
  source 1..163: mol_type = other RNA; note = Related to MCYX01000113.1; note = Vibrio splendidus
atcctttagtgtttagacattcagtctagtcgggcgataagccagactctaatttattggggagttctgcgattgcggtgtaaattttatccgcgttcgctcaacgagttcctcgtttctcggtcgcggataaaatctacaccgctgccttaagtaaaggatt

SEQ ID NO: 17033 - RNA, 160 nt, unidentified
  source 1..160: mol_type = other RNA; note = Related to ABIC01000002.1; note = Shewanella benthica
accctttagcgtttagacatttttgtctagtcgggcgataagccagactcaaatttattgggaagttctgcggttgcactaataaaattacgcaaccgctcaacgagtccctcgtttcacggttgcgtaattttattagcgcttcctttagtaatgggca

SEQ ID NO: 17034 - RNA, 156 nt, unidentified
  source 1..156: mol_type = other RNA; note = Related to NZ_WHZZ01000005.1; note = Photorhabdus khanii
gccctttagcgtgaagactatgtagtctagtcgggcgataagccagactctaaattattggaaggttatggggttgcggtaggaaaacgccgcaaccgctcacctgttctgttcccggttgcggcgttttcctaccgcatcctttagtaaagggtt

SEQ ID NO: 17035 - RNA, 85 nt, unidentified
  source 1..85: mol_type = other RNA; note = Related to NHOK01000005.1; note = Yersinia frederiksenii
attggggttgcggtaggaattctccgcaaccgctcacttgttcgcggttgcggagaattcctaccgcatcctttagtaaaaggca

SEQ ID NO: 17036 - RNA, 160 nt, unidentified
  source 1..160: mol_type = other RNA; note = Related to NZ_WMDE01000055.1; note = Photobacterium carnosum
cccctttagcgtatagacttttgtctagtcgggcgttacgccagactcaaatttattggggaacaattccggttgcggtgaaaaatttcccgcgggccggagttcgtacctcacatccggatcgcgggaaattttccaccgcttcctttagtaaagggga

SEQ ID NO: 17037 - RNA, 160 nt, Vibrio sp.
  source 1..160: mol_type = other RNA; note = Related to JAKEUP010000008.1
accctttagcgttaattggactagttttattggtctagtcgggcgatacgccagactcaaatttattggggaacaattttggttgcggttgaaaattttctggcccgactcgttcctcgtccggaagtaaattttaaaccgcttcctctagtaaagggat

SEQ ID NO: 17038 - RNA, 159 nt, Vibrio parahaemolyticus
  source 1..159: mol_type = other RNA; note = Related to AAZQRX010000007.1
accctttagcgcaggacatcatcgtctagtcgggtgttaagccagactcaaacttattggggactttgctggttgcggtgaaaaatttttcccgcgggcctgctcgttcctcgccggatagcgggaaaaattttccaccgcttcctttagtaaagggtt

SEQ ID NO: 17039 - RNA, 162 nt, Vibrio sp.
  source 1..162: mol_type = other RNA; note = Related to NZ_JAFNJW010000049.1; note = Vibrio crassostreae
accctttagtgttagacaaatttgtctagtcgggcgttacgccagactcaaacttattggagaataattccggttgcggtagaaaatttttccgcgagccggactcgttcctcctcctagaacgcggaaaagatttcctaccgcttcctttagtaaagggga

SEQ ID NO: 17040 - RNA, 152 nt, unidentified
  source 1..152: mol_type = other RNA; note = Related to JABCPW010000001.1; note = Serratia marcescens
gtcctttagcgttcagacgtttacgtctagtcgggcgattagccagactctaacttattgtaaagtttcgtggttgcggtattcgttctccgcagccgctcgaaaccttcgcggctgcggagaacgaataccgcatccttaagtaaagggct

SEQ ID NO: 17041 - RNA, 152 nt, unidentified
  source 1..152: mol_type = other RNA; note = Related to PEHA01000001.1; note = Serratia marcescens
gtcctttagcgttcagacgattgcgtctagtcgggtgattagccagactctaacttattgttaagtttcgtggttgcggtagttgttctccgcagccgcttgtaaacttcgcggctgcggagaacaactaccgcatccttaagtaaagggca

SEQ ID NO: 17042 - RNA, 152 nt, unidentified
  source 1..152: mol_type = other RNA; note = Related to AP021969.1; note = Raoultella ornithinolytica
gtcctttagcgttcagacggttacgtctagtcgggcgattagccagactctaacttattgttgggttccgtggttgcggtagtcgttctccgcagccgctcgaaaccatcgcggctgcggagaacgactaccgcatcctttagtaaagggca

SEQ ID NO: 17043 - RNA, 152 nt, unidentified
  source 1..152: mol_type = other RNA; note = Related to CP019077.1; note = Klebsiella pneumoniae
gtcctttagcgtttagacgattacgtctagtcgggtgattagccagactctaacttattgtggggtttcgtggttgcggtagtcgttctccgcagccgcttgaacccatcgcggctgcggagaacgactaccgcatcctttagtaaaggaca

SEQ ID NO: 17044 - RNA, 151 nt, unidentified
  source 1..151: mol_type = other RNA; note = Related to CP023009.1; note = Lonsdalea britannica
gccctttagcgttcagacggttacgtctagtcgggcgttaagccagactctaacttattgtggggtttcgtggttgcggtagtcgttcttcgcatccactcccctagtcgtggatgcgaagaacgactaccgcatcctttagtaaagggtt

SEQ ID NO: 17045 - RNA, 152 nt, Proteus sp.
  source 1..152: mol_type = other RNA; note = Related to NZ_CP029133.1; note = Proteus mirabilis
gtcctttagcgtttagacgattacgtctagtcgggtgattagccagactctaacttattgtgaggattcgtggttgcggtagtagttccctgcaaccgctcgaaatcttcacggcggcagggaactactaccgcatcctttagtaaaggacc

SEQ ID NO: 17046 - RNA, 153 nt, Enterobacter sp.
  source 1..153: mol_type = other RNA; note = Related to NZ_RXRP01000001.1; note = Enterobacter asburiae
gtcctttagcgttcagacggttacgtctagtcgggcgataagccagactcaaatttattggtcggattcgtggttgcggtagttgttctccgcagccgcgattagccaatcacggctgcggagaacaaccaccgcatcctttagtaaaggaca

SEQ ID NO: 17047 - RNA, 160 nt, unidentified
  source 1..160: mol_type = other RNA; note = Related to NZ_CP051652.1; note = Pectobacterium carotovorum
gtcctttagcgtatagacggtcatcgtcttgtcgggcgttcagccagacactaagttattggaaggtttatgaggttgcggtaggtataatcctccgccgctccatgccttgcatctcacggcggaggattatacctaccgcatccttaagtgaaggacg

SEQ ID NO: 17048 - RNA, 160 nt, unidentified
  source 1..160: mol_type = other RNA; note = Related to NZ_LR134116.1; note = Yersinia intermedia
gtcctttagcgtataggcgatcatcgtcttgtcgggcgtttagccagacactaagttattggaaggtttatgaggttgcggtaggtataatcctccgccgctccatgccttgcatctcgcggcggaggattatacccaccgcatccttaagtaaagggca

SEQ ID NO: 17049 - RNA, 160 nt, Salmonella sp.
  source 1..160: mol_type = other RNA; note = Related to AAXBOI010000003.1; note = Salmonella enterica
gtcctttagcgtatagacgaacatcgtcttgtcgggcgcttagccagacactaagttattggaaggtttatgaggttgcggtaggaataatcctccgccgctccatgccttgcatctcgcggcggaggattatccccaccgcatccttaagtaaagggca

SEQ ID NO: 17050 - RNA, 160 nt, Enterobacter sp.
  source 1..160: mol_type = other RNA; note = Related to NZ_LRCR01000003.1
gtcctttagcgtttagacgttttgcgtcttgtcgggtgattagccagacacaaagttattggaaggtttatgaggttgcggtaggtataatcctccgccgctcatggccttgcatttcgcggcggaggattatacccaccgcatccttaagtaaaggaca

SEQ ID NO: 17051 - RNA, 161 nt, Proteus sp.
  source 1..161: mol_type = other RNA; note = Related to JADSTR010000010.1; note = Proteus mirabilis
gtcctttagcgtgtagacgcttttcgtctagtcgggtgcttagccagacactaatttattgagtagtttttggggttgcggtaggtgtagttcaccgccgctccatcgctacgcatttcgcggcggtgaactacacctaccgcatccttaagtaaaggaca

SEQ ID NO: 17052 - RNA, 167 nt, unidentified
  source 1..167: mol_type = other RNA; note = Related to JAGVVN010000001.1; note = Methylovulum psychrotolerans
tctctttagagttttagaactaatcgcatattagtttagtcgggtgtttagccagactctaatttattgagtcgttttaggggcgcggaagctatttttcgcgcttctttcacttcttcgttcaaaaagcgcgaaaaatagcttccgctttatcaaggtaaagagat

SEQ ID NO: 17053 - RNA, 172 nt, unidentified
  source 1..172: mol_type = other RNA; note = Related to JAATWI010000006.1; note = Methylococcaceae bacterium WWC4
tctctttagcgttttagaactaatcaagtattagtttagtcgggtgtttagccagactctaacttattgagtcgttttaggggcgcggaagctatttttcgcgcttttcgtactcattctattcctccaaaaagcgcgaaaaatagcttccgctttatcaaggtaaagagat

SEQ ID NO: 17054 - RNA, 167 nt, unidentified
  source 1..167: mol_type = other RNA; note = Related to WTAZ01000264.1; note = Methylococcaceae bacterium
actctttagtgttttggattaataattttttgatctagtcgggcgtttagccagactcaaatttattgagtggttttaggttgcgaaatacattttctgcgcttcttaaactcattcttcatttcagaagcgcagaaaacatattccgcttcctttagtaaagagtt

SEQ ID NO: 17055 - RNA, 153 nt, unidentified
  source 1..153: mol_type = other RNA; note = Related to JACJDY010000010.1; note = Pseudoalteromonas sp.
actctttagcgtttttgagctgcttttcagcttagtcgggcgatacgccagactgtaatttattgaacggtattatgaatgcgaaagcctcgcatttattatctcgttcctcaataagaaatgcgagaccttcgctttcttaagtaaagagtc

SEQ ID NO: 17056 - RNA, 155 nt, unidentified
  source 1..155: mol_type = other RNA; note = Related to JAHKQX010000026.1; note = Shewanella sp.
actctttagcgttttagagctaatttttttggcttagtcgggcgatacgccagactgtaatttattgaacgacattatgaatgcgaaggtctcgcatttcatatttcgttcctcaataagaaatgcgagaccttcgctttctttagtaaagagta

SEQ ID NO: 17057 - RNA, 182 nt, unidentified
  source 1..182: mol_type = other RNA; note = Related to RCHN01000034.1; note = Ketobacter sp.
gccctttagcgttttagactaccaagaatctagtctagtcgggcgtttagccagactcaaaattattgcgtggcattgctgttgcggaagatgattttatattttccccactcctttcgctttgcagctccagtcgcggagaaaatataaaatcatcttccgcggcatcttagtaaagggca

SEQ ID NO: 17058 - RNA, 176 nt, unidentified
  source 1..176: mol_type = other RNA; note = Related to NZ_SLZR01000017.1; note = Reinekea marinisedimentorum
actctttagtgttattggacctacagtactttcggtctagtcgggcgtttagccagactcaaacttattgattaagattatgattgcggggttaaggctttgccctgattccctctctcattcttcgctcgggaatcagggcaaagccttaaccccgcggcctctagtaaagggtt

SEQ ID NO: 17059 - RNA, 171 nt, unidentified
  source 1..171: mol_type = other RNA; note = Related to NZ_CAJCKX010000049.1; note = Serratia sp.
gctctttagcgttggacatttttgtctagtcgggcgtttagccagactctaacttattgaacaggtttatgattgcgatacagaaaacatcgcatcataaactcacctcccttggcggtcggttcatttatgatgcgatgttttctgtatcgcagcttctagtaaagggca

SEQ ID NO: 17060 - RNA, 170 nt, unidentified
  source 1..170: mol_type = other RNA; note = Related to AP022371.1; note = Providencia rettgeri
gctctttagcgttagacatttttgtctagtcgggcgcttagccagactctaacttattgaacaggtttatgattgcgatacagaattcatcgcgtcataaacagacctccgatgacgtcggttcatttatgacgcgatgaattctgtatcgcggcttctagtaaagagta

SEQ ID NO: 17061 - RNA, 148 nt, Citrobacter sp.
  source 1..148: mol_type = other RNA; note = Related to CP058318.1; note = Citrobacter freundii
gcactttagcgttagacgattctgtctagtcgggcgttaagccagactctaacttattgaacaggtttatgattgcgatacataaaacatcgcgccataaactgacatgacgcgatgttttatgtatcgctacttttagtaaagggca

SEQ ID NO: 17062 - RNA, 185 nt, unidentified
  source 1..185: mol_type = other RNA; note = Alteromonadaceae bacterium; note = Related to JABSOI010000029.1
gctctttagcgtttggacttattttgttgtctaaaacacaatattagtctagtcgggcgttttgccagactcaaacttattgaacgattttatggtgcgaaacctttttatagatcaggttcgtacctcgttcctcgctacaaacctgatctataaaaaggtttcgcttcctttagtaaagagtt

SEQ ID NO: 17063 - RNA, 171 nt, unidentified
  source 1..171: mol_type = other RNA; note = Related to NZ_CP014322.1; note = Alteromonas stellipolaris
gctctttagtgttttcggacgaaatacgtctagtcgggtgtttagccagactcaaatttattgagccctctggggttgcgaattactcctgccctcggaggagttctaaagtgcgcaagcgcacccactcctccgagggcaggagtaattcgctgcgtctagtaaagagca

SEQ ID NO: 17064 - RNA, 146 nt, Aeromonas sp.
  source 1..146: mol_type = other RNA; note = Related to NZ_CDBH01000035.1; note = Aeromonas dhakensis
gctctttagtgttggacacattgtctagtcgggtgattagccagactctaatttattgagcagattaggttgcgaaagactcgcattcctatttccgcttcgctgcactaggaatgcgagtctttcgcttcctttagtaaagagcc

SEQ ID NO: 17065 - RNA, 160 nt, Aeromonas hydrophila
  source 1..160: mol_type = other RNA; note = Related to NZ_CP027804.1
gctctttagcgtatggacgatttcgtctagtcgggtgtttagccagactcaaatttattgaacagatttatggttgcgaaagcatcgcatacctagatccgttccgcttcgcttcactgttctaggtatgcgatgctttcgcttcctttagtaaagagca

SEQ ID NO: 17066 - RNA, 151 nt, unidentified
  source 1..151: mol_type = other RNA; note = Related to QEKR01000001.1; note = Pectobacterium versatile
gctctttagcttatggctcagtataaaagccttgtcgggcgcttcgccagacaccaacttattgaacgacaatgtggttgcgaaagtctcgcgccccaagctcgttaactcacttaggtcgcgagactttcgcttcctctagtaaagagtg

SEQ ID NO: 17067 - RNA, 152 nt, unidentified
  source 1..152: mol_type = other RNA; note = Related to JAENMV010000007.1; note = Lelliottia amnigena
gctctttagcttatggctctgtattaaaagccttgtcgggcgtttcgccagacaccaacttattgaacgacattgtggttgcgaaagtctcgcgacccaagctcgtcaactcacttaggtcgcgagactttcgcttcctctagtaaagagtg

SEQ ID NO: 17068 - RNA, 151 nt, unidentified
  source 1..151: mol_type = other RNA; note = Related to CP002824.1; note = Klebsiella aerogenes
gctctttagcttgtggctcagtattaaagccttgtcgggcgcttcgccagacaccaacttattgaacgacattgtggttgcgaaagtctcgcgacccaagttcgttaactcacttaggtcgcgagactttcgcttcctctagtaaagagcg

SEQ ID NO: 17069 - RNA, 149 nt, unidentified
  source 1..149: mol_type = other RNA; note = Related to JAADJV010000002.1; note = Rahnella aceris
accctttagctcaggctcaattcatcgggctagtcgggcgtttagccagactcaaacttattgaacgtcattttggttgcgaaagtctcgcaaccagagctcgttcctcactctggttgcgagactttcgcttccttcagtaaagggtg

SEQ ID NO: 17070 - RNA, 149 nt, unidentified
  source 1..149: mol_type = other RNA; note = Related to NZ_CP050508.1; note = Raoultella terrigena
actctttagcttaggctcaattcatcgggctagtcgggcgtttagccagactcaaacttattgaacgtcattttggttgcgaaagtctcgcaaccagagctcgttcctcactcaggttgcgagactttcgcttccttcagtaaagagta

SEQ ID NO: 17071 - RNA, 94 nt, Vibrio sp.
  source 1..94: mol_type = other RNA; note = Related to MCYT01000164.1
ctttagcttaaggctacagtaattttagcctagtcgggcgattagccagactcaaacatattgaacgagattttgggtgcgaaagcacataaag

SEQ ID NO: 17072 - RNA, 169 nt, Vibrio sp.
  source 1..169: mol_type = other RNA; note = Related to CP030798.1; note = Vibrio owensii
gctctttagcttatggctacaattatttagcctagtcgggcgattagccagactcaaacttattgaacgagaatttgggtgcgaaagcacataaagcatcgcgccctgacctcgttcctcgttcagggcgcgatgctttatgtactttcgcttcctttagtaaagagta

SEQ ID NO: 17073 - RNA, 151 nt, unidentified
  source 1..151: mol_type = other RNA; note = Related to NZ_UGHC01000001.1; note = Grimontia hollisae
gctctttagctttaggcttaccagtcttagcctagtcgggcgattagccagactcaaatttattgaacgagattttggttgcgaaagcatcgcaccctaagctcgttcctcacttagggtgcgatgctttcgcttcctccagtaaagagtc

SEQ ID NO: 17074 - RNA, 167 nt, Vibrio sp.
  source 1..167: mol_type = other RNA; note = Related to NZ_AP014635.1; note = Vibrio tritonius
gctctttagcttgtggctcaaattttagcctagtcgggcgattagccagactcaaacttattgaacgggtttttgggtgcgaaagcacataaagctttacgccccgctctcgttcctcgtttggggcgtaaagctttatgcactttcgcgtcctctagtaaagagct

SEQ ID NO: 17075 - RNA, 146 nt, Vibrio sp.
  source 1..146: mol_type = other RNA; note = Related to CP036500.1; note = Vibrio cholerae
gctctttagctttgggcttaattttcggcctagtcgggtgattagccagactcaaacttattgaacgagattttggttgcgaaagcatcgcgaccaatactagttcgtattggtcgcgatgctttcgcttcctctagtaaagagca

SEQ ID NO: 17076 - RNA, 152 nt, Vibrio sp.
  source 1..152: mol_type = other RNA; note = Related to NZ_SLWI01000001.1; note = Vibrio crassostreae
actctttagcgtttgggtgaaatttgatttacctagtcgggcgattagccagactgaaatttattgaacgggtttttggttgcgaaagcatcacatcctaaactcgttcctcatttaggatgtgatgctttcgcttcctctagtaaagggta

SEQ ID NO: 17077 - RNA, 153 nt, unidentified
  source 1..153: mol_type = other RNA; note = Related to JAJVEH010000001.1; note = Aliivibrio fischeri
actctttagcgttcgggttaaatattaatttacctagtcgggcgattagccagactgaaacttattgaacgggtttttgggtgcgaaagcatcacatcctaaattcgttcctcatttaggatgtgatgctttcgcttcctctagtaaagggtt

SEQ ID NO: 17078 - RNA, 190 nt, unidentified
  source 1..190: mol_type = other RNA; note = Related to NZ_JWGX01000025.1; note = Shewanella sp.
gctctttagcgttttgggcttttaaggtgttcaatgatcaatctaatcagcctagtcgggtgtatagccagactgaaacttattgaacgggatttaggttgcgaaagcaagaaattgctacgttgcctaaatcttagtcgatttaggcaacgtagcaatttcttgctttcgcttcctccagtaaagagca

SEQ ID NO: 17079 - RNA, 168 nt, Enterobacter sp.
  source 1..168: mol_type = other RNA; note = Related to NZ_CP041062.1; note = Enterobacter ludwigii
gctctaaacgtgtatggcatatttagttatgcttgtcgggcgcttagccagacactttcatattgaacggctttagggttgcgcttggtgtgcctctggattgcactcctagtttcacgtcgtcgcgcaatccagaggaacaccaagcgcttcctctaggtaagagct

SEQ ID NO: 17080 - RNA, 168 nt, unidentified
  source 1..168: mol_type = other RNA; note = Related to NZ_CP031104.1; note = Leclercia sp.
gctctaaacgtgtgtggcatatttagttatgcttgtcgggcgcttagccagacactttcatattgaacggcattagggttgcgcttggtgtgcctctggattgcactcctagctgcacgtcgtcgcgcaatccagaggaacaccaagcgcttcctctaggtaagagct

SEQ ID NO: 17081 - RNA, 168 nt, unidentified
  source 1..168: mol_type = other RNA; note = Related to NZ_JAIVKM010000013.1; note = Mangrovibacter yixingensis
gctctaaacgtgtatggcatatttagttatgcttgtcgggcgcttagccagacacttttatattgaacggctttagggttgcgcttggtgtgcctctggattgcactcctagttgcacgtcgtcgcgcaatccagaggaacaccaagcgcttcctctaggtaagagca

SEQ ID NO: 17082 - RNA, 166 nt, unidentified
  source 1..166: mol_type = other RNA; note = Related to NZ_JAAQVP010000001.1; note = Providencia rettgeri
gctctaacgtgtatggcatattcagatatgctggtcgggcgtttagccagacactttaatattgaacggctttagggttgcgcttggtgtgcctctggattgcactcctcgcaagcatcctcgcgcaatccagaggaacaccaagcgcttcctctaggtaagagca

SEQ ID NO: 17083 - RNA, 157 nt, unidentified
  source 1..157: mol_type = other RNA; note = Related to JAKUDL010000001.1; note = Shewanella sp.
actctttagcttctggacttctaaagtctagtcgggcgattagccagactgttaactattgagcacacttaggccgcgttataaagaattacgccgatcctgagcttgtgctcaagatcggcgtaattctttataacgcttcctttagtaaagagta

SEQ ID NO: 17084 - RNA, 154 nt, unidentified
  source 1..154: mol_type = other RNA; note = Related to WBJR01000006.1; note = Hydrogenovibrio sp.
gctctttagcgttgtagcttacttaattttgctatgtctgtcgattcgacggaccctaacttattgagtgtttttggtgggcgaaagaattaatttctttcgtgcctaaagtcactcaagaaattaatttttcgccccattagtgtaaagagcc

SEQ ID NO: 17085 - RNA, 158 nt, unidentified
  source 1..158: mol_type = other RNA; note = Related to NZ_UGYV01000001.1; note = Shewanella morhuae
tctctttagcgtttcgggctttaattttgcctagtcgggcgtttcgccagacactaacttattgaggtcacttgggagcaccagcaaactttctgctgagcctttcgtacctcaaggatcaccagaaagtttgctggtgcctcctttagtaaagagag

SEQ ID NO: 17086 - RNA, 162 nt, unidentified
  source 1..162: mol_type = other RNA; note = Related to PJAR01000040.1; note = Glaciecola sp.
tctctttagcgtttagagtcggtttacgacttagtcgggcgattagccagacacaaatttattgagtatattggatgcgttaggaaactttctttcggttcctgctcgcaagctcactaggatccgaaataaagtttcctaacgcctactaagtaaagagat

SEQ ID NO: 17087 - RNA, 162 nt, unidentified
  source 1..162: mol_type = other RNA; note = Related to NZ_BMLS01000007.1; note = Bowmanella pacifica
actctttagcgtttaggctgttgaaattttaagccttgtccggcgattcgccagacacaaacttattgagcacatctgggctgcgttagatatttatctaccgatccttcgtgcctcaggagcggtagataaatatctaacgcttcctctgagtaaagagtt

SEQ ID NO: 17088 - RNA, 161 nt, unidentified
  source 1..161: mol_type = other RNA; note = Related to BMOT01000001.1; note = Shewanella aestuarii
actctttagcgtttaggctgtttaaattcacggcttgtccggcgattcgctagacacaaatttattgagcacatttgggctgcgttagatatttatctaccgatccttcgtgcctcaggagcgatagataaatatctaacgcttcctttgagtaaagagtg

SEQ ID NO: 17089 - RNA, 159 nt, unidentified
  source 1..159: mol_type = other RNA; note = Related to JADYXE010000008.1; note = Pseudoalteromonas sp.
actctttagcgtttaggcgaatattatctgccttgtctggcgtttcgctagacacaaatttattgagcacatttgggctgcgttagatatttatctaccgatccttcgtgcctcaggagcgatagataaatatctaccgcttcctctgagtaaagagtt

SEQ ID NO: 17090 - RNA, 162 nt, unidentified
  source 1..162: mol_type = other RNA; note = Gammaproteobacteria bacterium HGW-Gammaproteobacteria-15; note = Related to PGZF01000002.1
actctttagcgtttaggctgttgtaaattactgccttgtccggcgtttcgctagacactaaattattgagcacatttgggctgcgttagatatttatctaccgatccttcgtgcctcacgagcggtagataaatatctaacgcttcctctgagtaaagagtt

SEQ ID NO: 17091 - RNA, 159 nt, unidentified
  source 1..159: mol_type = other RNA; note = Related to NZ_CP027426.1; note = Klebsiella oxytoca
actctttagcgttaggctttgatttatagccttgtcgagcgtttcgccagacactaacttattgagtacttttagggttgcgctagaaagttttctaccgatcctagaagtctctaggatcggtagaaaactttctagcgcctcctctagtaaagagta

SEQ ID NO: 17092 - RNA, 164 nt, unidentified
  source 1..164: mol_type = other RNA; note = Related to NZ_WUBS01000016.1; note = Acerihabitans arboris
actctttagcgttacgggccttttttagccttgtcgggcgattcgccagacactaacttattgagcacatttagggttgcgctagatacgaatctaccgatcctagattgctgcgcatcaaggatcggtagattcgtatctagcgcctcctttagtaaagagtg

SEQ ID NO: 17093 - RNA, 167 nt, unidentified
  source 1..167: mol_type = other RNA; note = Related to NZ_LUUH01000065.1; note = Methylomonas methanica
gctctttagcgttttgactatgttctctattaatagtcttgtctggcgattcgccagacactaacttattgttgacatttaggttgcgttagaaaattttctaccgctcctccgtgtcctccggatcgctagaaaattttctaacgcccccttaaatgtaaagagta

SEQ ID NO: 17094 - RNA, 163 nt, unidentified
  source 1..163: mol_type = other RNA; note = Related to MAJP01000040.1; note = Aliivibrio fischeri
gctctttagcgtttgggctaaataaatatttacgccttgtctggcgtttcgctagacactaacttattgggtacatttaggttgcgttagaaaattttctaccgatccttcgtacctcaggagcgatagaaaaccttctaacgctggcctctagtaaagagtt

SEQ ID NO: 17095 - RNA, 133 nt, unidentified
  source 1..133: mol_type = other RNA; note = Related to LZOY01000008.1; note = Haemophilus haemolyticus
actctttagcgtataagcaatttgctttgtcaggcgtttcgctagaccctaacttattgattagatttaggttgcgttagaaaaatttctgacnngtcagaaatttttctaacgcggccttaagtaaagagta

SEQ ID NO: 17096 - RNA, 143 nt, Pasteurella sp.
  source 1..143: mol_type = other RNA; note = Related to NZ_CP028926.1; note = Pasteurella multocida
actctttagtgtttaagcatttgctagtcgggcgtttcgctagactctaacttattgagaggatttggctgcgttagaatattttcagccgatccttgcaggagcagctgaaaatattctaacgcttccttaagtaaagagta

SEQ ID NO: 17097 - RNA, 145 nt, unidentified
  source 1..145: mol_type = other RNA; note = Related to NZ_CP063116.1; note = Haemophilus parainfluenzae
actctttagcgtataagcaatttgcttagtcgggcgtttcgctagacacaaacttattgattagatttaggttgcgttagaaaatttctgacgatcctaaatcggagcgtcagaaattttctaacgcggcctttagtaaagagat

SEQ ID NO: 17098 - RNA, 150 nt, unidentified
  source 1..150: mol_type = other RNA; note = Related to NZ_SLYB01000005.1; note = Cricetibacter osteomyelitidis
actctttagcgtttgtaagcaaattgctcagtcaggtgtttagctagactcaaatttattgattagatttaggatgcgttagaaaattttctatcgatcctggattcggagcgatagaaaattttctaacgcggcctttagtaaagagta

SEQ ID NO: 17099 - RNA, 161 nt, Aeromonas sp.
  source 1..161: mol_type = other RNA; note = Related to NZ_AP022188.1; note = Aeromonas media
actctttagcgtttgggctttgttttaaatagccttgtcaggcgattcgccagacactaatttattgagcacatttagggttgcgaaagatgcttttcttccgatccttcgtgcctcacgagcggaagaaaagcatctttcgcctcctttagtaaagagtt

SEQ ID NO: 17100 - RNA, 160 nt, Aeromonas sp.
  source 1..160: mol_type = other RNA; note = Related to NZ_AP022264.1; note = Aeromonas veronii
actctttagcgttttggcttcgttatacaagccttgtcgggcggttcgctagacacaaatttattgagcacatttagggttgcgaaagatgcatttcttccgatccttcgtgcctcacgagcggaagaaatgcatctttcgcctcctttagtaaagagtt

SEQ ID NO: 17101 - RNA, 159 nt, Aeromonas sp.
  source 1..159: mol_type = other RNA; note = Related to NZ_JMGO02000012.1; note = Aeromonas enteropelogenes
actctttagcgtatgggctttcatttttagcctagtcgggcgattcgctagactcaaatttattgagcacatttagggttgcgaaagatgtatgtcttccgatccttcgtgcctcacgatcggaagacatacatctttcgcttcctttagtaaagagtt

SEQ ID NO: 17102 - RNA, 177 nt, unidentified
  source 1..177: mol_type = other RNA; note = Related to NZ_PEAX01000003.1; note = Alteromonas flava
actctttagcgttttggacttgttgacttccaaaagtgtcaatatacgtcttgtctggcgtttcgccagacactaatttattgggtacatttagggttgcgaaagatacttttctcacgatccttcgtccctcacgagcgtgagaaaactatctttcgcttccgacagtaaagagtg

SEQ ID NO: 17103 - RNA, 159 nt, unidentified
  source 1..159: mol_type = other RNA; note = Related to DQNK01000125.1; note = Gammaproteobacteria bacterium
actctttagcgtacaggcttgcggttatagcctagtctggcgtttcgccggacacaaatttattgagcacatttagggttgcgaaagatgtatttcttccgatccctcgtgcctcgcgagcggaagaaatacatctttcgcttcctctagtaaagagtg

SEQ ID NO: 17104 - RNA, 168 nt, unidentified
  source 1..168: mol_type = other RNA; note = Related to JAEINI020000025.1; note = Alishewanella sp.
ccttttacgcgtttaggcaatatagtcttaatttgacaaagcctcgtccggcgtttcgctcgacttacgtttattgaacacttttagggttgcgctaaagcacttctgtcaagatccactgaagtggaacatgccagaagtcttcagcgcagcctctaggtaaaagga

SEQ ID NO: 17105 - RNA, 173 nt, Acinetobacter sp.
  source 1..173: mol_type = other RNA; note = Related to NZ_CP055277.1
tctctttagtttttttataaattcgactatctttctttgatagaaaattttataaaagtttagcgtttcgctaaactaacgttattgtgagaaatttaggataccattagatgaatttcttcgtacctaaagttacttagaaattaatctaacgctatcctgagtaaagagat

SEQ ID NO: 17106 - RNA, 165 nt, Acinetobacter sp.
  source 1..165: mol_type = other RNA; note = Related to MVON01000005.1
tctctttagcctttttataaaacgaactattttgggtagttttataaaagtttagcgtttcgctaaactaatgttattgtgagaaatttaggcttgcgttagatgaatttctgcgcacctaaaggagcttagaaattcatctaacgctatcctgagtaaagagat

SEQ ID NO: 17107 - RNA, 170 nt, Acinetobacter sp.
  source 1..170: mol_type = other RNA; note = Related to JADWNN010000006.1; note = Acinetobacter bereziniae
tctctttagccttttttataaaactaactatccttatggataagttttgtaaaagtttagcgattcgctaaattaatgttattgtgagaaatttaggtttgcgttagatgaatttctgcgcgcctaaaggagcttagaaattcatctaacgctatcctgtgtaaagagat

SEQ ID NO: 17108 - RNA, 174 nt, Acinetobacter sp.
  source 1..174: mol_type = other RNA; note = Related to DADAZD010000003.1; note = Acinetobacter baumannii
atcctttagcgttatttaagttgactaatacgttagtaacttaaatagtttggcgtttcgccaaacttaatttgattgtgaccatttagggttgcgctaatcaaatttttcttcatacggcttagtcgcctgtactcagaaaaattagattaccgcatccctgtgtaaaggatt

SEQ ID NO: 17109 - RNA, 167 nt, Acinetobacter sp.
  source 1..167: mol_type = other RNA; note = Related to NZ_CP061828.1; note = Acinetobacter seifertii
ttcctttagcgtaatttaagttcactaattttttagtaacttaaatagtttggtgtttcgccgaactctatttgattgtgaccatttagggttgcgctaattaaattttcttcatacgtctcgccgtattcagaaaattcaattaccgcatccctgtgtaaagaaat

SEQ ID NO: 17110 - RNA, 155 nt, Acinetobacter sp.
  source 1..155: mol_type = other RNA; note = Related to NEGC01000003.1
actctttagctttatttaggttactaaaacctaaatagttcggcgtttcgccgaactctaatcgattgtcaacttctagggttgcgctaattccctttttcctcatcctaaaggaatcggaaaaatgaaattaccgcatccctgtgtaaagagtt

SEQ ID NO: 17111 - RNA, 179 nt, unidentified
  source 1..179: mol_type = other RNA; note = Related to NZ_JAGKLI010000001.1; note = Providencia rettgeri
acctttacgcgtaggataactcattttatccttgtcgggcgtttcgccagacactaatttattgtggacatttagggttgcgcttcagcacttttagccagatcctgaatgccactcgcaggcttcgtgtccttcaggagctgtctaaaagtctaaagcgcatcctttaggtaaaggta

SEQ ID NO: 17112 - RNA, 178 nt, Proteus sp.
  source 1..178: mol_type = other RNA; note = Related to CP049941.1; note = Proteus mirabilis
acctttacgcgtgggataacttattaatccttgtcgggcgtttcgccagacactaatttattgtgaacatttagggttgcgctttagcacttttagccagatcctgaatttcactgcgcaggcttgttccattcaggagccgtctaaaagtctaaagcgcatcctttaggtaaaggac

SEQ ID NO: 17113 - RNA, 170 nt, Salmonella sp.
  source 1..170: mol_type = other RNA; note = Related to CP074281.1; note = Salmonella enterica
gcctttacgcgtgggataactggtttatccttgtcgggcgtttcgccagacactaatttattgtggacatttagggttgcgctttagcactttcagcaagatccttcatgccactgcgtttcattcaggagcttgctgaaagtctaaagcgcatcctttaggtaaagggg

SEQ ID NO: 17114 - RNA, 171 nt, unidentified
  source 1..171: mol_type = other RNA; note = Related to NZ_CP033901.1; note = Klebsiella quasipneumoniae
acctttacgcgtgggataacaggtttatccttgtcgggcgtttcgccagacactaacttattgtggacatttagggttgcgcttcagcactttcagcaagatccttcattccactgcgtttcatttcaggagcttgctgaaagtctaaagcgcatcctttaggtaaagggg

SEQ ID NO: 17115 - RNA, 171 nt, unidentified
  source 1..171: mol_type = other RNA; note = Related to NZ_CP049115.1; note = Pantoea stewartii
gcctttacgagtgggataaaagttttatccttgtcgggcgtttcgccagacactaacttattgtggacatttagggttgcgctttagcactttcagcaagatccttcattccactacgttacatttcaggagcttgctgaaagtctaaagcgcatcctttaggtaaaggtc

SEQ ID NO: 17116 - RNA, 173 nt, Escherichia coli
  source 1..173: mol_type = other RNA; note = Related to ABCQBJ010000001.1
acctttacgcgtgggataacaaatggtttatccttgtcgggcgtttcgccagacactaatttattgtggatatttagggttgcgcttcagcactttcagcaagatccttcattccactgcgtttcattcaggagcttactgaaagtctgaagcgcatcctttaggtaaaggat

SEQ ID NO: 17117 - RNA, 170 nt, unidentified
  source 1..170: mol_type = other RNA; note = Related to NZ_CP023484.1; note = Dickeya sp.
gcctttacgcgtgggataatctttttatcctagtcgggcgtttcgccagactctaacttattgtggatatttagggttgcgcttcagcactttcagcaagatccttcattccactgcgtttcattcaggagcttactgaaagtctgaagcgcatcctttaggtaaagggt

SEQ ID NO: 17118 - RNA, 170 nt, unidentified
  source 1..170: mol_type = other RNA; note = Related to RJLS01000002.1; note = Dickeya undicola
gcctttacgcgttgggataatgttttatcctagtcgggcgtttcgccagactctaatttattgtggacatttagggttgcgcttcagcactttcagcaagatccttcattccactgcgtttcattcaggagctcactgaaagtctgaagcgcatccttcaggtaaaggat

SEQ ID NO: 17119 - RNA, 169 nt, unidentified
  source 1..169: mol_type = other RNA; note = Related to JZYL01000045.1; note = Pluralibacter gergoviae
ctctttacgcgtgggatatttttatcctagtcaggcgtttcgccagactctaacttattgtggatttctagggttgcgcttcttagtttgagcgggatcctgctctccactcagtcgtttcgtttaggatcccgctcaaactaagaagcgcatcctctaggtaaagggt

SEQ ID NO: 17120 - RNA, 169 nt, Citrobacter sp.
  source 1..169: mol_type = other RNA; note = Related to JADVIA010000001.1; note = Citrobacter braakii
ctctttacgcgtgggatatttttatcctagtcgggcgtttcgccagactctaacttattgtgaatatctagggttgcgcttcgtcgtttgagcgggatcctgcattccactaagtcgttccaattaggatcccgctcaaacgaagaagcgcatcctctaggtaaagggt

SEQ ID NO: 17121 - RNA, 160 nt, unidentified
  source 1..160: mol_type = other RNA; note = Related to MVGB01000005.1; note = Serratia marcescens
ctctttacgcgtgggatatattatttgttatcctagtcgggcgattagccagactctaacttattgcgaataattgggttgcgctaaatacttttggcacgatcctgagcaagcacaggagcgcgccaaaagtatttagcgcatcctctaggtaaagaga

SEQ ID NO: 17122 - RNA, 157 nt, unidentified
  source 1..157: mol_type = other RNA; note = Related to NZ_CABHXL010000034.1; note = Yersinia kristensenii
ctctttacgcgtgggatatttatccttgtccggcgattcgccagacactaatttattgcgaacatttagggttgcgcttaagcacttttggcacgatccttcgctaatcactcaggaatgtgccaaaagtctgaagcgcatcctctaggtaaagaga

SEQ ID NO: 17123 - RNA, 160 nt, unidentified
  source 1..160: mol_type = other RNA; note = Related to NZ_CACSJK010000006.1; note = Rahnella variigena
ctctttacgcgaagggtaacttagttattatccttgtcgggcgtttcgccagactctaacttattgcgtgtgattgggttgcgctaaatacttttggcacgatccttcgcgcactcaggagcgcaccaaaagcatttagcgcatcctctaggtaaaggga

SEQ ID NO: 17124 - RNA, 162 nt, Enterobacter cloacae
  source 1..162: mol_type = other RNA; note = Related to JAJFTC010000002.1
ctctttacgcgaaggataacaatcaggttaatccttagtcgggcgtttcgctagactctaacttattgcgtgtgattgggttgcgctaaatgcttttggcacgatccttcacaagctcaggagcgcaccaaaagcatttagcgcatcctctaggtaaaggga

SEQ ID NO: 17125 - RNA, 160 nt, unidentified
  source 1..160: mol_type = other RNA; note = Related to JPOT02000001.1; note = Pantoea agglomerans
ctctttacgcgaaggataccaaacggtttatccttgtcgggcgtttcgccagactctaacttattgcgtgtgattgggttgcgctaaatacttttggcacgatcctgcgcaagcttaggagcgcaccaaaagcatttagcgcatcctctaggtaaagaga

SEQ ID NO: 17126 - RNA, 154 nt, unidentified
  source 1..154: mol_type = other RNA; note = Related to NZ_CP034938.1; note = Pectobacterium odoriferum
atctttacgcgtgggtttatagtattaaacctagtcgggcgattagccagacatacagtattgaggacacttagggttgcgcaaaagcacttctctaacgatccttaatcaggagcgtcagagaagtcttttgcgcatcctctaggtaaagatt

SEQ ID NO: 17127 - RNA, 155 nt, Citrobacter sp.
  source 1..155: mol_type = other RNA; note = Related to JADVFW010000007.1; note = Citrobacter braakii
atctttacgcgaaggtttatgttacttaaacctagtcgggcgattagccagacatacagtattgaggacacttagggttgcgcaaaagcacttctctaacgatccttgatcaggagcgtcagagaagtcttttgcgcatcctctaggtaaagatt

SEQ ID NO: 17128 - RNA, 153 nt, unidentified
  source 1..153: mol_type = other RNA; note = Related to JAKZMT010000006.1; note = Pantoea ananatis
atctttacgcgtgggtttaaagaattaaacctggtcgggcgattagccagacatctagtattgaggacacttagggttgcgcaaaagcacttctctaacgatccttggcaggagcgtcagagaagtcttttgcgcatcctttaggtaaagatc

SEQ ID NO: 17129 - RNA, 156 nt, unidentified
  source 1..156: mol_type = other RNA; note = Related to JAAAXN010000025.1; note = Serratia fonticola
atctttacgcgtgggtttataagttagtaagcctggtcgggcgataagccagacatacagtattgaggactcttagggttgcgcaaaagcacttctctaacgatccttaatcaggagcgttagagaagtcttttgcgcatccttcaggtaaagata

SEQ ID NO: 17130 - RNA, 161 nt, Vibrio sp.
  source 1..161: mol_type = other RNA; note = Related to NZ_CP049914.1
tcctttacgcgttggttttgttacaaacagaacttgtcgggcgcatcgccagacagtaatttattgtggacatttagggttgcgcttcagcactttccgcacgatccttcgttcctcaggagcgcacgaaaagtcttcagcgcctcctttaggtaaaggca

SEQ ID NO: 17131 - RNA, 159 nt, Vibrio sp.
  source 1..159: mol_type = other RNA; note = Related to NZ_CP053541.1; note = Vibrio europaeus
tcctttacgcgtggttttgtatgtacaaaacttgtcgggcgtatcgctagacagtaatttattgaggatatttagggttgcgcttcagcactttccgcacgatccttcgttcctcaggagcgcacgaaaagtcttcagcgcatccttaaggtaaaggtt

SEQ ID NO: 17132 - RNA, 162 nt, Aeromonas sp.
  source 1..162: mol_type = other RNA; note = Related to NZ_LR134376.1; note = Aeromonas encheleia
gcctttacgcgtgggttttgtcattgtacaaaccttgtcaggcgattcgccagacagtaacttattgtggacatttagggttgcgcttcagtactttccgcacgatccttcgtccctcaggagcgcacgaaaagtcttcagcgcatcctttaggtaaaggtt

SEQ ID NO: 17133 - RNA, 164 nt, unidentified
  source 1..164: mol_type = other RNA; note = Related to CP001796.1; note = Pseudoalteromonas sp.
ctctttacgcgtgggataacgcacaacagtttatccttgtcgggcgattagccagacactattttattgaaggtatttagggttgcgctaaagcacttctctaaagatccttcgttcctcaggagcgttagagaagtcttcagcgcatcctctaggtagagaga

SEQ ID NO: 17134 - RNA, 164 nt, Vibrio parahaemolyticus
  source 1..164: mol_type = other RNA; note = Related to NZ_CAJOAG010000011.1
ctctttacgcgtgggataacgcaaaacagtttatccttgtcgggcgattagccagacactaacttattgaaggtatttagggttgcgctaaagcacttctctaaagatccttcgttcctcaggagcgttagagaagtcttcagcgcatcctctaggtaaaggga

SEQ ID NO: 17135 - RNA, 185 nt, Vibrio sp.
  source 1..185: mol_type = other RNA; note = Related to MCWA01000032.1; note = Vibrio splendidus
ctctttacgcgtaagatagcaaacagtttgtttatctttgtcgggcgtttcgctagacactaacttattgagaacatttagggttgcgctgaagcactttcagtaggatccttcgctctccctcgtacctcggtcgcgctcacgagcctactaaaagtctccagcgcatcctctaggtaaagagt

SEQ ID NO: 17136 - RNA, 185 nt, unidentified
  source 1..185: mol_type = other RNA; note = Related to WMDC01000029.1; note = Photobacterium carnosum
ctctttacgcgtaagataacaaacgatttgtttatctttgtcgggcgtttcgctagacactaacttattgagaacatttagggttgcgctaaagcactttaagcaagatccttcgctctccctcgtacctcggtcgcgctcacgagctcacttaaagtctccagcgcatcctctaggtaaagagt

SEQ ID NO: 17137 - RNA, 176 nt, unidentified
  source 1..176: mol_type = other RNA; note = Related to NZ_BMYW01000013.1; note = Vogesella alkaliphila
atctttacgcgtaggatactgctctatatttattttgagttgcttatcctgtctggcgtttcgtccagacatatgttattgacgatttttagggttgcgctaaagcacttccctatcgatccttcgtacctcaggagcgctagggaagtctttagcgcatcctttaggtaaagata

SEQ ID NO: 17138 - RNA, 175 nt, unidentified
  source 1..175: mol_type = other RNA; note = Oxalobacteraceae bacterium; note = Related to JACYUE010000003.1
taccttacgcgtagggcagattcgtagttggttgcatttgtccttgtcgggcgattagccagacacaaatttattgaggatatttaggttgcgtcaagagctcgcctaacgatccttcgaaaccccacctcaggagcgttagtcaatctcttaacgcatcctttaggtaaggaaa

SEQ ID NO: 17139 - RNA, 166 nt, unidentified
  source 1..166: mol_type = other RNA; note = Related to NZ_JACHXD010000002.1; note = Massilia violacea
taccttacgcgtgggacagatttattttttgtccttgtcgggcgtttagccagacacgaatttattgaggatatttaggttgcgttaaaggcttgcctaacgctccctcgataccccacctcgcgatcgttagtcaagcctttaacgcatcctttaggtaaggaaa

SEQ ID NO: 17140 - RNA, 176 nt, Alcaligenes sp.
  source 1..176: mol_type = other RNA; note = Related to JAKUDK010000002.1
ttccttacgcgttgggacagattctgaatcgacaatatttgtccttgtcgggcgtttagccagacactcatttattgaggatatttaggttgcgtcaaacgcgcgcttaacgatccttcgaaaaagcacctcaggagcgttaagcgcgcgtttgacgcatccttaaggtaaggaaa

SEQ ID NO: 17141 - RNA, 165 nt, unidentified
  source 1..165: mol_type = other RNA; note = Related to NZ_CP086370.1; note = Massilia sp.
ctctttacgcgcggggttagtagatactttacgtaatccttgtcgggcgcttagccagacactaatttattgaggacacttaggttgcgttaaatgctttcctaacgatccttcgtgcctcaggagcgttaggaaaccctttaacgcctcctttaggtaaagagt

SEQ ID NO: 17142 - RNA, 178 nt, unidentified
  source 1..178: mol_type = other RNA; note = Related to NZ_CP048832.1; note = Janthinobacterium lividum
tactttacgtgtgggatacattccttcataagaatttgtccttgtcgggcgcttcgctagacactaatttattgcggatatttagggttgcgttaaagacttccctatcgatccttcctccactgcgttccctcaggatcgctaggaaagcctttaacgcttcctttaggtaaagtat

SEQ ID NO: 17143 - RNA, 170 nt, Pseudomonas sp.
  source 1..170: mol_type = other RNA; note = Related to DAFPVK010000010.1; note = Pseudomonas aeruginosa
ctctttacgcgttgggatatgaatggctctgtaattgatatcctggtcgggcgattcgccagaccctcacttattgaggatttttagggttgcgctaaaggcttctctatcgatccttcgttcctcaggagcgctagagaagcctttagcgcatcctctaggtaaagagt

SEQ ID NO: 17144 - RNA, 162 nt, unidentified
  source 1..162: mol_type = other RNA; note = Related to JAKFZQ010000002.1; note = Pseudoalteromonas sp.
actctttagcgattttgggctttgacattctagcctagtcgggcgattagccagactctaacttattgagcacatctagggttgcgttatataaatttataccgatccttcgtgcctcaggagcggcataaatttatataacgcttcctctagtaaagagta

SEQ ID NO: 17145 - RNA, 162 nt, unidentified
  source 1..162: mol_type = other RNA; note = Related to NZ_LR877185.1; note = Pseudoalteromonas sp.
actctttagcgttgggatgattccttgaattaacctagtcgggcgattagccagactctaacttattgagcacatttagggttgcgttataaagttttataacgatccttcgtgcctcaggagcgctataaaactttataacgcttcctctagtaaagagtg

SEQ ID NO: 17146 - RNA, 164 nt, Vibrio sp.
  source 1..164: mol_type = other RNA; note = Related to NZ_LBGP01000014.1; note = Vibrio metoecus
gctctttagcgttttgggtagaatttgaattcaaccttgtcgggcgtttcgctagacactaacttattgattgtatttagggttgcgttagaacttttctaacgatccttcgtacctcaggagcgtcagagaaagttctaacgctagcctctgagtaaagagtt

SEQ ID NO: 17147 - RNA, 163 nt, unidentified
  source 1..163: mol_type = other RNA; note = Related to BMPZ01000002.1; note = Shewanella gelidii
actctttagcgtttgggtagaataccaattcaaccttgtcgggcgattcgctagacactaacttattgagtgtatttagggttgcgttagaacttttctgacgatccttcgtacctcaggagcgtcagagaaagttctaacgctagcctctgagtaaagagta

SEQ ID NO: 17148 - RNA, 162 nt, Vibrio sp.
  source 1..162: mol_type = other RNA; note = Related to JAEMEZ010000008.1; note = Vibrio cholerae
actctttagcgtttgggtcgaatttgaattcaaccttgtcgggcggttcgccagacactaacttattgagtgcatttagggttgcgttagaacttttctaacgatccttcgtgcctcaggagcgtcagaaaagttctaacgctagcctctgagtaaagagta

SEQ ID NO: 17149 - RNA, 161 nt, Vibrio sp.
  source 1..161: mol_type = other RNA; note = Related to NZ_CP026321.1; note = Vibrio campbellii
actctttagcgtttgggttgataaatatcacaccttgtcgggcggttcgccagacactaacttattgagtgcatttagggttgcgttagaacttttctaacgatccttcgtgcctcaggagcgtcagaaaagttctaacgctagcctctgagtaaagagtt

SEQ ID NO: 17150 - RNA, 160 nt, Vibrio sp.
  source 1..160: mol_type = other RNA; note = Related to VHSP01000001.1
actctttagcgtttgggtcgaatttcagttcaaccttgtcgggcgattcgctagacactaacttattgagtgcatttagggttgcgttagaacttttctaacgatcctcgtgcctcggagcgccagaaaagttctaacgcgagcctctgagtaaagagtt

SEQ ID NO: 17151 - RNA, 163 nt, unidentified
  source 1..163: mol_type = other RNA; note = Related to JACJEU010000008.1; note = Shewanella sp.
actctttagcgtattggattaagttataacttaatcttgtcgggcgtttcgccagacactaatttattgagcatatttagggttgcgttagaacgttttctaacgatccttcgttcctcaggagcgccagaaaagttctaacgctggccactagtaaagagtt

SEQ ID NO: 17152 - RNA, 163 nt, Vibrio sp.
  source 1..163: mol_type = other RNA; note = Related to RKQY01000017.1; note = Vibrio crassostreae
gctctttagcgtattgggtcgagtgtaaactcaaccttgtcgggcgtttcgccagacactaacttattgagtgtatttagggttgcgttagaacgttttctaacgatccttcgtacctcaggagcgtcagaaaagttctaacgctagcctctagtaaagagtt

SEQ ID NO: 17153 - RNA, 162 nt, unidentified
  source 1..162: mol_type = other RNA; note = Related to NZ_FOHV01000012.1; note = Thorsellia anophelis
accttttagcgaatatgaagtaagctttgttacttcttgtcaggcgtttcgccagactaaatcttattgattttatttagcttgcgttggagctgttttgcctatccttcgctagcttcggataggcaaaacagctccaacgctatcctaaagtaaaaggtt

SEQ ID NO: 17154 - RNA, 165 nt, unidentified
  source 1..165: mol_type = other RNA; note = Related to NZ_CP088265.1; note = Leclercia sp.
actctttagcgtatgggctttagttatatagccttgtcgggcgtttcgccagacacgaacttattgtttacatttagggttgcgtcagatgcaaatcggccgatcctgctcgctcactcacacgatcggccgatttgcatccgccgcatcctttagtaaagagtt

SEQ ID NO: 17155 - RNA, 161 nt, unidentified
  source 1..161: mol_type = other RNA; note = Related to CP020501.1; note = Serratia marcescens
actctttagcgtatgggcttcaatacagccttgtcgggcgtttcgccagacactaacttattgtttagatttagggttgcgtcagatgcaaatcggccgatcctgctcgttcctcacacgatcggccgatttgcatccgccgcatcctttagtaaagagtt

SEQ ID NO: 17156 - RNA, 182 nt, Pseudomonas sp.
  source 1..182: mol_type = other RNA; note = Related to NZ_JADBHI010000015.1; note = Pseudomonas arcuscaelestis
ctctttacgcgttttaggagctttcgagctctagtctggtgtatagccggactctaatttattgaacggtattagttgcgacgaaggctcgcgtgggcttcactcgtcgcactcgtgccttagcactcgcactcctcgcaaatcccacgcgagccttcgccgctatatctttggtaaagaga

SEQ ID NO: 17157 - RNA, 174 nt, Pseudomonas sp.
  source 1..174: mol_type = other RNA; note = Related to NZ_CP025261.1
ctctttacgcgttttaggagctttcgagctctagtccggtgtatagccagactctaatttattgaacggtattagttgcgacgaaggctcgcgtgggcttcactcgtcgcactcgtacctcgcactcctcgcaaagcccacgcgagccttcgccgctatatcttggtaaagaga

SEQ ID NO: 17158 - RNA, 172 nt, Pseudomonas sp.
  source 1..172: mol_type = other RNA; note = Related to NZ_CP067098.1
ctctttacgcgttttggagcgcaagctctagtccggtgtatagccagactctaatttattgattggtattagttgcgacgaaggctcgcgtgggcttcactcgtcgcactcgtacctcgcactcctcgcaaagcccacgcgagccttcgccgctatatctttggtaaagaga

SEQ ID NO: 17159 - RNA, 161 nt, Pseudomonas sp.
  source 1..161: mol_type = other RNA; note = Related to DORR01000095.1
ctctttacgcgtttttggagcgcaagctctagtccggtgtatagccagactctaatttattgatcggctttagttgcgacgaaggctcgtgtgggcttcagtcgtcgttcctcctcctaaagcccacacgagccttcgtcgctatatctttggtaaagaga

SEQ ID NO: 17160 - RNA, 172 nt, Pseudomonas sp.
  source 1..172: mol_type = other RNA; note = Related to NZ_JAHSTY010000001.1; note = Pseudomonas azadiae
ctctttacgcgttttggagcgcaagctctagtccggtgtatagccagactctaatttattgattggcattagttgcgacgaaggctcgcgtgggcttcactcaaagcgctcgtccctcgcactcctcgcgaatcccacgcgagccttcgccgctatatctttggtaaagaga

SEQ ID NO: 17161 - RNA, 162 nt, Pseudomonas fluorescens
  source 1..162: mol_type = other RNA; note = Related to LKEF01000044.1
ctctttacgtgttttggagcttcactgctctagtcgggtgtatagccagactctaatttattgattggctttagttgcgacgaagtcccgcgtgggcctcagtcgtcgttcctcctcctaaagcccacgcgggacttcgtcgctatatctttggtaaagagc

SEQ ID NO: 17162 - RNA, 162 nt, Pseudomonas sp.
  source 1..162: mol_type = other RNA; note = Related to FOQB01000015.1; note = Pseudomonas syringae
ctctttacgtgctttggagcttcattgctctagtcgggtgtatagccagactctaacttattgattggctttagttgcgacgaagtcccgcgtgggcctcagtcgtcgttcctcctcctaaagcccacgcgggacttcgtcgctatatctttggtaaagagc

SEQ ID NO: 17163 - RNA, 161 nt, Pseudomonas sp.
  source 1..161: mol_type = other RNA; note = Related to NZ_CP077085.1; note = Pseudomonas shahriarae
ctctttacgtgctttggggcttcgtgctctagtcgggtgtatagccagactctaatttattgatcggctttagttgcgacgaagtcccgcgtgggcctcagtcgtcgttcctcctcctaaagcccacgcgggacttcgtcgctatatctttggtaaagagc

SEQ ID NO: 17164 - RNA, 170 nt, Pseudomonas sp.
  source 1..170: mol_type = other RNA; note = Related to NZ_VDNQ01000002.1; note = Pseudomonas oryzihabitans
ctctttacgcgtttttggagctttgattttataaggctctagtcgggtgtatagccagactcaaaattattgattggctttagttgcgacgaagttccgcggggacttcagtcgccgttccgcctcctaaagcccccgcgaaacttcgtcgctatatcttggtaaagagc

SEQ ID NO: 17165 - RNA, 160 nt, unidentified
  source 1..160: mol_type = other RNA; note = Related to NC_015554.1; note = Alteromonas naphthalenivorans
atctttacgcgtttttatgggcttaggccctagtcgggtgtatagccagactctaatttattgattggatttagttgcgatgaatgcctatctggaattcatcttcgttcctcagctaaattccagataggcattcatcgctatatctgaggtaaagata

SEQ ID NO: 17166 - RNA, 159 nt, unidentified
  source 1..159: mol_type = other RNA; note = Related to JADZHD010000030.1; note = Shewanella algae
atctttacgtgatttaagagcctcggctctagtcgggtgtatagccagactctaacttattgattggatttagttgcgatggatgcctatccgggattcatcttcgtccctcagctaaatcccggataggcatccatcgctatatctgaggtaaagata

SEQ ID NO: 17167 - RNA, 162 nt, Chromobacterium sp.
  source 1..162: mol_type = other RNA; note = Related to NZ_CP029554.1; note = Chromobacterium phragmitis
tactttacgcgttttacgggctttaatggcctagtcgggtggatagccagactctaacttattgatcggcataggttgcgatgaaggatcggcttggtttcagccgctccttagcggccaaaaccaagccgatccttcatcgcttcattcttggtaaagagc

SEQ ID NO: 17168 - RNA, 166 nt, unidentified
  source 1..166: mol_type = other RNA; note = Related to NZ_KB913033.1; note = Hydrogenovibrio halophilus
ctctttacgtgttaaatgagttaacgaattcatttagtcaggtgtttagccagactttagtttattgattggcattaggctgcgctgaaggctttttagccttcattacgctcctacgtcgctagaaggctaaaaagccttcagcgctgccgttgaggtaaagtgc

SEQ ID NO: 17169 - RNA, 170 nt, unidentified
  source 1..170: mol_type = other RNA; note = Related to JAKISK010000029.1; note = Thiomicrorhabdus sp.
ctctttacgtgtttaagcattgtgtatatgttttagtctggtgtaaatcggacgcaattttattgtggacatttggccgcgcagaagtataaaaatacttcgctccacgcttgttccaatccctgcgcaaagtatttttatacttctgcgctactctcgaggtaaagagc

SEQ ID NO: 17170 - RNA, 182 nt, unidentified
  source 1..182: mol_type = other RNA; note = Related to BLYD01000277.1
ctctttacgtgttttatgaggcacaatcattaatttagtgctttagtctggcgtatagcaagactcatgtttattgagcggttttaattgcgataaagtctctttcagacttcatcgccatccgctttgctccagttgtgaagtctgaaagagactttatcgctttctttaaggtaaagagt

SEQ ID NO: 17171 - RNA, 159 nt, Pseudomonas sp.
  source 1..159: mol_type = other RNA; note = Related to NZ_KE384408.1; note = Pseudomonas azotifigens
ctttttacgcgttttggtgctgttttatgcactagtcgggtgtacagccagactcaaatttattgatcggctttagttgcgacgaatgtccgtctgggcttcactcgcttcactcctaaagcccagacgaacattcgtcgcattcttttggtaaaaagc

SEQ ID NO: 17172 - RNA, 141 nt, Pseudomonas sp.
  source 1..141: mol_type = other RNA; note = Related to JACAOT010000014.1; note = Pseudomonas tolaasii
ctctttacgcgtttatgtgcgcaagcactagtcgggtgtatagccagactctaagttattgatgtgatttagttgcgacggatggtcgggcgggctnnnnagcccgcccgaccatccgtcgctatatccttggtaaagagc

SEQ ID NO: 17173 - RNA, 152 nt, unidentified
  source 1..152: mol_type = other RNA; note = Related to CAJHIV010000001.1; note = Methylomonas albis
ctctttacgcgtttatatggaaatttaagtatgtcgggcgctcagccagacccaaaattattgataagatttagttgcgcagaaggcttcttcggtcttccgcgtcgctacagcccaaagaagccttctgcgcttccttaaaggtaaagagt

SEQ ID NO: 17174 - RNA, 171 nt, Vibrio sp.
  source 1..171: mol_type = other RNA; note = Related to NZ_QLYY01000008.1
acctttacgcgtggatttgaaaaacgagaattcgttgttcaatcttgtcgggcgctcagccagacaaatgtttattgaggatatttagggctgcgcaagcatcgctttgcacgatccttcgttcctcaggagcgcacaaagcgatgcttgcgcttcctttaggtaaaggca

SEQ ID NO: 17175 - RNA, 170 nt, Vibrio sp.
  source 1..170: mol_type = other RNA; note = Related to JAHVKH010000015.1; note = Vibrio hangzhouensis
acctttacgcgtagttttgaacaacgtactttcgttattcaatcttgtcgggcgttcagccagacacatgtttattgaggttatttaggtcgcgcaagcatcgctttgcacgatccttcgtgcctcaggagcgcacaaagcgatgcttgcgccccctttaggtaaaggca

SEQ ID NO: 17176 - RNA, 169 nt, Vibrio sp.
  source 1..169: mol_type = other RNA; note = Related to MSCG01000002.1; note = Vibrio splendidus
acctttacgcgtggatttgaggatgcttgtcattcttgatcttgtcgggcgcttagccagacacactgtttattgaggacatttagggctgcgcaagcatagcttcgcacgatccttcgttcctcaggagcgcacgaagctatgcttgcgcttcctttaggtaaaggaa

SEQ ID NO: 17177 - RNA, 171 nt, Vibrio sp.
  source 1..171: mol_type = other RNA; note = Related to NZ_CP049331.1; note = Vibrio ziniensis
acctttacgcgtggatactgagttgacgctgttaacttatatcttgtcgggcgtttagccagacacacagtttattgaggacatttagggctgcgcaagcttcgctttgcacgatccttcgttcctcaggagcgcacaaagcgaagcttgcgcttccttaaggtaaaggca

SEQ ID NO: 17178 - RNA, 154 nt, Vibrio sp.
  source 1..154: mol_type = other RNA; note = Related to RHPA01000002.1; note = Vibrio cholerae
ctctttacgcgaattggggtgaaaaccctagtcgggtgtacagccagactcaaatttattgagcgggattaggtgcgctagaggcctctgcgggccccagtcgcaggctcctaaaacccgcagaggcctctagcgcttcctttaggtaaagagt

SEQ ID NO: 17179 - RNA, 154 nt, Vibrio sp.
  source 1..154: mol_type = other RNA; note = Related to AAXPSE010000001.1; note = Vibrio vulnificus
ctctttacgcgaattggggtgaaaaccctagtcgggtgtacagccagactcaaatttattgagcgggattaggtgcgctagaggcctctgcgggccccagtcgcaagctcctaaaacccgcagaggcctctagcgcttcctttaggtaaagagt

SEQ ID NO: 17180 - RNA, 178 nt, unidentified
  source 1..178: mol_type = other RNA; note = Related to OBMM01000001.1; note = Thalassospira xiamenensis
ctctttacgcgaggtgctttacggcacggtcaggcgtatcgccagaccctaacttattgacggtttcttggcgcgataagatggtttctttcttatcttattccgcctcgctgaccgcgcttcgtcgaaataagataagaaagaaaccatcttatcgcttcttcttaaggtatagagc

SEQ ID NO: 17181 - RNA, 161 nt, unidentified
  source 1..161: mol_type = other RNA; note = Related to GG703517.1; note = Ruegeria sp.
ctctttacgcgttgtgctaagtggcacggtcaggtgtatagccagacccaattttattgatcgcattttggcgcgataagaagaactctctcttatcgagtccgcgttcgcttgttcgataagagagagctcttcttatcgcttctttaaaggtattgagc

SEQ ID NO: 17182 - RNA, 163 nt, unidentified
  source 1..163: mol_type = other RNA; note = Related to AMRK01000002.1; note = Celeribacter baekdonensis
ctctttacgcggatgtgcggcaacgcacggtctggtgcacagccggaccctaatttattgatcgcatcttggcgcgataagaacataaagtccttatcgctcttgcaagtattcagaacaataaggactttatgttcttatcgcttcttcaaaggtactgagc

SEQ ID NO: 17183 - RNA, 167 nt, unidentified
  source 1..167: mol_type = other RNA; note = Related to LMCG01000004.1; note = Pseudovibrio sp.
atctttacgcggagtgcttgtagagcacggtcgggcttacagctagacccacacttattgacggcatttaagtgcgattggaaggaaaatttcctatcactctcaaagccgtagtttctcgattgacaggaaattttccttccaatcgcccctttgaggtaaagagt

SEQ ID NO: 17184 - RNA, 158 nt, unidentified
  source 1..158: mol_type = other RNA; note = Related to NZ_VFSV01000069.1; note = Paenimaribius caenipelagi
acccttacgcggaacgctcttaatgagcgtagtctggtgtacagccggactctaacttattgatttcattttggcgcgataagaccaagaaggtcttatcaaagccgtagtttcgctaagaccttcttggtcttatcgcaccttcaaaggtagggggc

SEQ ID NO: 17185 - RNA, 156 nt, unidentified
  source 1..156: mol_type = other RNA; note = Related to JAKCFH010000010.1; note = Rhodovulum sulfidophilum
acccttacgcggaacgctctactgagcgtagtctggtgtacagccggactctaacttattgttaccatttgggcacgataagaccaagaaggtcttatcaaagccgtagtttcgataagaccttcttggtcttatcgcacctttaaggtaggggcc

SEQ ID NO: 17186 - RNA, 144 nt, unidentified
  source 1..144: mol_type = other RNA; note = Related to FONF01000022.1; note = Marinobacter sp.
tcctttacgcgtgctcgtacaagcgagttgtgtctggtggatagccggaccctgaattattggaggcatttaggtgcgctggaggcgctacagtctcctatgcggagcctgtagcgcctccagcgcccctttaaggtaaaggac

SEQ ID NO: 17187 - RNA, 157 nt, Desulfovibrio desulfuricans
  source 1..157: mol_type = other RNA; note = Related to NZ_CP072608.1
ctctttacgcggtaagtcttgtccaacaaggctgagtctgatgtttcgtcagacagaattttattgttagctgttatcggcacttcgggccttcgcattatctcccgaagcctccgataatgcgaaggcccgaagtgcctctctctaggtaaagaga

SEQ ID NO: 17188 - RNA, 155 nt, unidentified
  source 1..155: mol_type = other RNA; note = Alphaproteobacteria bacterium; note = Related to JAFXQN010000116.1
atctttacgtgctaaggagttatactctaatgtctgatgtttgattggactgctcgtttattgttacattttatcgtccttgggactctgatatttcatctcccttgctgtacgataaaatatcagagtcccaaggactttcaaaggtaaagatg

SEQ ID NO: 17189 - RNA, 151 nt, unidentified
  source 1..151: mol_type = other RNA; note = Related to PBKZ01000009.1; note = Rheinheimera sp.
gaagttgtgcttattcaagcgtaacttttgtggttggtgtatagccaacccgaatagatcgtgatgtatccatgtggtactaaacagaatctccatctgctctagagcagattgaccttctgtttagtacccagaagatcagataatctcc

SEQ ID NO: 17190 - RNA, 176 nt, unidentified
  source 1..176: mol_type = other RNA; note = Related to LZFG01000013.1; note = Photobacterium phosphoreum
agcccttagtgaggtttgttttctataaaatgaacctttgtggttggtgtatagccaacccgtagagattgctcgatatttgttgatactaaacagagacgagctgctcatccttcgcagaacgtctctgtttagtatcacagaagtttcgcaagctcactcctgagtaagggctt

SEQ ID NO: 17191 - RNA, 179 nt, Vibrio sp.
  source 1..179: mol_type = other RNA; note = Related to SMCU01000001.1; note = Vibrio crassostreae
agcccttagtttggttgctttcgagtagcctatggttggtgtatagccgacctgacgacattgatcgtgattgtgttgcactaaacagaaacacgatccgttcgtacctcactgagcgtgtttctgtttagtgcaagccgtttcacttgctgcgcaagttcacgcctttgtaagggctt

SEQ ID NO: 17192 - RNA, 175 nt, unidentified
  source 1..175: mol_type = other RNA; note = Related to NZ_WMDI01000001.1; note = Photobacterium carnosum
acccttagttctggttgcttttaagtaatcaatggttggtgtatagccgacctgacgacattgattgtaattgtgttgcactaaacataattacgatccgtgagtgcctcactgagcgtaattatgtttagtgcagacgttcacttgctacgcagtttacgtctttgtaagggtt

SEQ ID NO: 17193 - RNA, 178 nt, Vibrio sp.
  source 1..178: mol_type = other RNA; note = Related to NZ_ADAF01000002.1; note = Vibrio mimicus
agcccttagcgtggttactttcgggtagccaacggttggtgtatagccgacctgacgaaattgatcgtgattgtgttgcactaaacagaatcacgatccgttcgtacctcactgagcgtgattctgtttagtgcaagccgtttcgcttgctgcgcaacctcacgccttgtaagggctt

SEQ ID NO: 17194 - RNA, 179 nt, Vibrio sp.
  source 1..179: mol_type = other RNA; note = Related to NZ_JPTQ01000476.1; note = Vibrio harveyi
agcccttagcgtggctactttcgagtagcctatggttggtgtatagccgacctgacgaaattgatcgtgactgtattgcactaaacagattcacgatccgttcgtacctcacggagcgtgattctgtttagtgcaagccgtttcgcttgctgcgcaacctcacgccttagtaagggctt

SEQ ID NO: 17195 - RNA, 180 nt, Vibrio sp.
  source 1..180: mol_type = other RNA; note = Related to NZ_CP046834.1; note = Vibrio vulnificus
agcccttagttttggttacccttgggtaatctatggtaggtgtatagccaacctgatggaattgatccggattatgttgcactaaacataatcaagatccattcgtacctcatggagcgtgattatgtttagtgcaagccgtttcacttgctacgcaagttcacgccttggtaagggctt

SEQ ID NO: 17196 - RNA, 175 nt, unidentified
  source 1..175: mol_type = other RNA; note = Related to JQED01000055.1; note = Colwellia psychrerythraea
tatccttagtttgaagaaagtgcctcggtattttcttttgtggttggtgtatagccgacccgttcgtattgttcggaattgtagtacgtaactacgtaaattccgaaccgctcggaactcgctgagcgtaatttacgtagttacgtacagtcgcaggctcctctagtaaggatat

SEQ ID NO: 17197 - RNA, 160 nt, unidentified
  source 1..160: mol_type = other RNA; note = Related to NZ_VWXD01000007.1; note = Pantoea sp.
tacccttagtttggaagtgcttaggcatttcttgtggttggtgtatatccgacccgttactattgtttggtttctcgtcgcaagaacgcgaggcgtcacgaggctccactcgcctcgagccacctcgcgatcttgcgcctcgtaacctgtgtaagggcat

SEQ ID NO: 17198 - RNA, 159 nt, unidentified
  source 1..159: mol_type = other RNA; note = Related to NZ_CABDVS010000002.1; note = Raoultella planticola
tacccttagtttggaagtgcttaggcatttcttgcggttggtgtatatccgacccgttactattgtttggtttctcgccgcaagaacgcgaggcgtcacgaggctcgctagcctcgtgccacctcgcgagctcgcgtctcgtaacctgtgtaagggcaa

SEQ ID NO: 17199 - RNA, 157 nt, unidentified
  source 1..157: mol_type = other RNA; note = Related to CP077366.1; note = Pantoea agglomerans
acccttagtttggaagtgctccggcatttcttgtggttggtgtatatccgacccgttactattgtttggtttctcgtcgcaagaacgcgaggcgtcacgaggacagccgtcctcgtgccacctcgcgatcttgcgcctcgtaacctgtgtaagggct

SEQ ID NO: 17200 - RNA, 159 nt, unidentified
  source 1..159: mol_type = other RNA; note = Related to CP026980.1; note = Pectobacterium parmentieri
tacccttagtctgggagtgcttattgcatttcttgcggttggtgcttagccgacccgattatattgtttggtttctcgtcgcaagatcgagccgcggcacgaggacctcatcctcgagccacgtctcgagctcacgcctcgtaacctatgtaagggtaa

SEQ ID NO: 17201 - RNA, 168 nt, Enterobacter sp.
  source 1..168: mol_type = other RNA; note = Related to FVZI01000003.1
gcccttagtttggaaagtgcaaatgcattttcttgcagttggtgtatagccgactcgatattgttgtttggtttctcgccgcacgatcgcgaggcgtcacgaggcgttgcgagccctcacgcctcgtgacgcctcgcgagcccacgtctcgtaaccagtgtaagggta

SEQ ID NO: 17202 - RNA, 146 nt, Enterobacter cloacae
  source 1..146: mol_type = other RNA; note = Related to BPMY01000001.1
tacccttagttagaaagcatgcagcatgctttcttgtggttggtgtatagccgacccggtgtagttgtgtggtttctcaccgcgagatcgagaagtgtctcgccgacacttctcgagcttgcgcttcgtgacctgtgtaagggaat

SEQ ID NO: 17203 - RNA, 160 nt, unidentified
  source 1..160: mol_type = other RNA; note = Related to NZ_CABHYG010000014.1; note = Yersinia proxima
tgtccttagttagaaagtgcctatgcattttcttgtggttggtgtatagccgacccggtattgttgtgtggtttctcgccacaagatcgcgaggcgtcacgaggcgccctcgcctcgagccacctcgcgagcctgtgtctcgtaacctgtgtaagggcat

SEQ ID NO: 17204 - RNA, 163 nt, Proteus sp.
  source 1..163: mol_type = other RNA; note = Related to NZ_CP054157.1; note = Proteus vulgaris
gcccttagttagaaaatgtgtattttatgcgttttcttgtggttggtgcatagctgacccgatattgttgtgtggtttctcgccacaagatcgcgagtcgtcgcgaggcgatcgcgcctcgctccgcctcgcgagcctgtgtctcgtaacctgtgtaaggggt

SEQ ID NO: 17205 - RNA, 149 nt, unidentified
  source 1..149: mol_type = other RNA; note = Related to CQAZ01000033.1; note = Yersinia pekkanenii
ggcccttagttagagagtgcctaatatggttactttcttgtggttggtgtatagccgacccggtattgttgtttggtttctcatcgcaagatcgggccgcgtcggtagacgcttcccgagcctgcgtctcgtgacctatgtaagggtat

SEQ ID NO: 17206 - RNA, 139 nt, unidentified
  source 1..139: mol_type = other RNA; note = Related to JADUBR010000008.1; note = Serratia marcescens
tacccttagttagggagtgccttaggcgctttcttggttggtgtatagccgacctggttttattgtttggtatctcgccgcacgatcgtgaggtgtctgcacctcacgagcttgcgtctcgtgacctgtgtaagggtaa

SEQ ID NO: 17207 - RNA, 154 nt, Escherichia coli
  source 1..154: mol_type = other RNA; note = Related to CP057980.1
tgcccttagcaggaaagtacattcaatatgttactttctagtggttggtgtttagccaactcgtatggattgcttggtatctcgacacaagttagccttgtgtcatttatagacaccaggctaacttgtgtctcgggaactcttgtatgggcat

SEQ ID NO: 17208 - RNA, 137 nt, unidentified
  source 1..137: mol_type = other RNA; note = Related to NZ_JAEMHM010000012.1; note = Geomesophilobacter sediminis
acccctagttgaaaggagcacaactcctttctgtggttggtgtatagccgacccgtatatattgttggatactctatgcacatgttcgctgaaggtcctttcatcaaacatgtgcttcgcaactccgagtaggggaa

SEQ ID NO: 17209 - RNA, 116 nt, unidentified
  source 1..116: mol_type = other RNA; note = Verrucomicrobia bacterium; note = Related to QHPH01000062.1
cgtcctagtttgtgagggctataccacctctgtgtggctggtgcatagccggcccgtttagattgtacggtattttcgccctccgtttcacggagggctcgctctaagtaggacaa

SEQ ID NO: 17210 - RNA, 165 nt, unidentified
  source 1..165: mol_type = other RNA; note = Related to NZ_FOXY01000012.1; note = Donghicola eburneus
cactcttagctgggtgtttttacgaaaatgctctacgccgggtgattagccaggctgtactagattgaacgacattgggcgccgactttgattggttttgtcggccccggtcttcgcctcggcgccgacaaaaccaatcaaagtcggacgcttaagtaagagaac

SEQ ID NO: 17211 - RNA, 166 nt, unidentified
  source 1..166: mol_type = other RNA; note = Related to NZ_LGHS01000039.1; note = Pseudorhodobacter aquimaris
tactcttagctgggtgttttagccgaaaacgctctatgccgggtgatttgccaggctgtatttgattgaacgactttgggcgccgacttcgaatggttttgtcggccccggtcttcgcctcggcgccgacaaaaccattcgaagtcggacgcttaagtaagagaat

SEQ ID NO: 17212 - RNA, 165 nt, unidentified
  source 1..165: mol_type = other RNA; note = Related to NZ_RBIG01000007.1; note = Oceanibaculum indicum
tactcttagctgggtgtttttgccgaaacactctatgccgggcgatttgccaggctgaatttgattgaacgacattgggcgccgacttcgaataactttgtcggccccggtctacgcctcggcgccgacaaagttattcgaagtcggacgctcaagtaagagaac

SEQ ID NO: 17213 - RNA, 162 nt, unidentified
  source 1..162: mol_type = other RNA; note = Related to CP069017.1; note = Pseudosulfitobacter pseudonitzschiae
ttctcttagctgggtgttttctgaacgctctacgccgggtgattcgccaggctgatttcaattgaacgatatcgggcgccgacttcgaaatgtttgtcgtcaccggtcgttcctcctcggagccgacaaacatttcgaagtcggacgcttaagtaagagatt

SEQ ID NO: 17214 - RNA, 164 nt, unidentified
  source 1..164: mol_type = other RNA; note = Related to NZ_MBST01000045.1; note = Ensifer sp.
cactcttagctgagtgtggttgcgagacactctatgccgggcgattggccaggctgtactcgattgaacgattttgggcgccgacttcgaatcattttgtcggccccggtcgttgcctcggagccgacaaaatgattcgaagtcggacgcttaagtaagagaat

SEQ ID NO: 17215 - RNA, 158 nt, unidentified
  source 1..158: mol_type = other RNA; note = Related to RHWX01000009.1; note = Brevundimonas sp.
atcccttcgctttaagggtgtcactctacgccgggtgtaaaccaggctgtattcgattgcgtgacatgggcaacgacaacgggcttccgtgtcgcccccggtcaagcggactcggcgccgacacggaagcccgttgtcgtcgctcaaagtaagaggtt

SEQ ID NO: 17216 - RNA, 175 nt, unidentified
  source 1..175: mol_type = other RNA; note = Related to JADCLP010000001.1; note = Erythrobacteraceae bacterium E2-1 Yellow Sea
gcctcttagctgggtgaagtccaacttcgggccaaactctatgccgggcgtttagccaggctgaattaaattgcgcgacaatgggcgccgatttcggaatccgaattcgaccccgggctatgtcgcctcggcgccgaattcggattccgaaatcggtcgctctaagtaaggggaa

SEQ ID NO: 17217 - RNA, 174 nt, unidentified
  source 1..174: mol_type = other RNA; note = Related to NZ_CP033204.1; note = Sphingopyxis sp.
gcctcttagctgggtgaagcctaatagaaggccaactctacgccgggtgtttagccaggctgaattaaattgcgcgacaatgggcgccgatttcggaatccgaagtcgaccccgggctcagtcgcctcggcgccgacttcggattccgaaatcggcgcgctcaagtaaggggtt

SEQ ID NO: 17218 - RNA, 156 nt, unidentified
  source 1..156: mol_type = other RNA; note = Rhodospirillaceae bacterium; note = Related to VBWB01000009.1
tccctttggttatcgggggacgctctatgccgggcgtaagccaggctgaaattgattgcgcgagattcggcgccgacttcgggactccgggccggtgccggcctccgtctcggcaccggcccggagtcccgaagtcggccgcttaatgtaagaggt

SEQ ID NO: 17219 - RNA, 167 nt, unidentified
  source 1..167: mol_type = other RNA; note = Related to NZ_AP018907.1; note = Blastochloris tepida
gcctcttagctgggtgcgagccctttggggcaacactctatgccgggtgtaaaccaggctgaatcagattgagtgagtttgggcgccgacttcgggtcccggagcggcgccggctcacactcggcgccgctccgggacccgaagtcggccgctttgagtaagaggca

SEQ ID NO: 17220 - RNA, 159 nt, unidentified
  source 1..159: mol_type = other RNA; note = Related to NZ_BACU01000350.1; note = Azospirillum sp.
ctcccttagtgtaaaagggggcctcactctatgccgggtgtaaaccaggctgaatgtaattgcgaagattgggcgccgacttcggaatccgcggtcggcaccggctttcgctcggcgccgaccgcggattccgaagtcggccgcttagggtaagaggac

SEQ ID NO: 17221 - RNA, 163 nt, unidentified
  source 1..163: mol_type = other RNA; note = Related to NZ_JACNMM010000013.1; note = Oceaniglobus trochenteri
ctctcttagctgggttctagcaagcgagaactctacgccgggtgtttagccaggctgaattgaattggacgctttcgggcgccggcttcggccttcgaagtcgagcccggctgcgctcggtctcgacttcgaaggccgaagccggccgcttaagtaagggaat

SEQ ID NO: 17222 - RNA, 163 nt, unidentified
  source 1..163: mol_type = other RNA; note = Related to NZ_CP033435.1; note = Cereibacter sphaeroides
ctctcttagctgggttctgacaagcgagaactctacgccgggtgattagccaggctgaactgaattgtacgcttttgggcgccgacttcagccttcgaagtcgagcccggcttcgctcggtctcgacttcgaaggccgaagccggacgcttaagtaagaggta

SEQ ID NO: 17223 - RNA, 161 nt, unidentified
  source 1..161: mol_type = other RNA; note = Related to NZ_LGSQ01000001.1; note = Pannonibacter phragmitetus
cctcttagttgggttctgttaagcgagaactctatgccgggtgtatagccaggctgaactgaattggacgcttttgggcgccgacttcggccttcggagtcgagcccggctgcactcggcctcgcctccgaaggccgaagtcggtcgcttaagtaagaggt

SEQ ID NO: 17224 - RNA, 168 nt, unidentified
  source 1..168: mol_type = other RNA; note = Related to NZ_LSRP01000113.1; note = Pararhizobium antarcticum
gcctcttagttgggtgtgtgtagctacaactcactctatgccgggtgtttagccaggctgaattttattgtgcgacattgggcgccggcttcgggaatccgaggcggcaccggcatgcgctcggcaccacctcggattcccgaagccggccgcttaaagtaaggggtc

SEQ ID NO: 17225 - RNA, 168 nt, unidentified
  source 1..168: mol_type = other RNA; note = Related to FMVA01000017.1; note = Rhizobium sp.
gcctcttagttgggtgtgtgtagctacagctcactctatgccgggtgtttagccaggctgaatcttattgtgcgacattgggcgccggcttcgggaatccgaggcggcaccggcatgcgctcggcaccacctcggattcccgaagccggccgcttaaagtaaggggtc

SEQ ID NO: 17226 - RNA, 168 nt, unidentified
  source 1..168: mol_type = other RNA; note = Related to NZ_QJRY01000001.1; note = Rhizobium wuzhouense
gcctcttagttgggtgtgtgtagctacagctcactctatgccgggtgtttagccaggctgaatcttattgtgcgacattgggcgccggcttcgggaatccgagtcggcaccggcatgcgctcggcaccacctcggattcccgaagccggccgcttaaagtaaggggtt

SEQ ID NO: 17227 - RNA, 178 nt, unidentified
  source 1..178: mol_type = other RNA; note = Proteobacteria bacterium; note = Related to JAIUNO010000183.1
gcctcttagctgggtggaacacctttagccaaaggtggcactctacgccgggtgaaagctaggctgtaagcgattgcgcgagtttgggcgccgacttcgaaacccggagccggcaccggccgcgtgcgtctcggcgccgtctccgggttccgaagtcgggcgctctaagtaagagggc

SEQ ID NO: 17228 - RNA, 182 nt, unidentified
  source 1..182: mol_type = other RNA; note = Related to NZME01000040.1; note = Thalassospira sp.
aactcttagtgagggttggtgccttgtctgggcgctcaactcaatgccgggtgcatagccaggcttattctattgcgcgacatggtggcgccggatttagctaatcctgagccattgggtccgcaagtgcttcctcaatggctcaggattagctaaatccggccgcttctaggtaagagttc

SEQ ID NO: 17229 - RNA, 142 nt, unidentified
  source 1..142: mol_type = other RNA; note = Related to JAEUOZ010000023.1; note = Rubrivivax sp.
gccacttagctgaaccgttgtcgggttctgtgccgggtgtacagccaggccgattggcattgaacgacatcgtcgcggcaaatccctcggggttcgcctaacggcgaaccccgagggatttgcctcgtccaagtaggtggct

SEQ ID NO: 17230 - RNA, 141 nt, unidentified
  source 1..141: mol_type = other RNA; note = Related to NESB01000001.1; note = Limnohabitans sp.
gtcacttagctgaaccgcagtcgaggttctgtgccgggcgtacagccaggccgatggcattgaccgacatcgtcaggcgaatccctcggggttcgcctagcgtcgaaccccgagggattcgcctcgtccaagtaggtggca

SEQ ID NO: 17231 - RNA, 153 nt, unidentified
  source 1..153: mol_type = other RNA; note = Related to NZ_CP093331.1; note = Pseudoxanthomonas daejeonensis
gctatctagctggactcaacctgttccatgttgggttccgtgccgggtgtacagccaggccgatcagtttgaacgtcatcgttgcggcgaatccctttgggcttcgcctacggcaaaccccaaagggattcgccgctatcagggtagatagct

SEQ ID NO: 17232 - RNA, 145 nt, unidentified
  source 1..145: mol_type = other RNA; note = Related to JAFLDZ010000021.1; note = Xanthomonadales bacterium
gccacttagctgaaccgttgtcgcggttctgtgccgggcgtacagccaggccgattggtattgatcgacatcgtcgcggcgaatccctctggggtttgcctagcggcaaaccccagagggattcgcctcgatccagtaggtggca

SEQ ID NO: 17233 - RNA, 143 nt, unidentified
  source 1..143: mol_type = other RNA; note = Proteobacteria bacterium; note = Related to JAFECW010000526.1
gccatctagctgaaccaggaaaggttctgtgccgggtgtacagccaggccgaatggtattgaacgactttgtcgtggcgaagccctcacggcttttcctaacgtcaaagccgagagggcttcgccccgatcaagtaggtggcc

SEQ ID NO: 17234 - RNA, 144 nt, unidentified
  source 1..144: mol_type = other RNA; note = Related to DNQH01000067.1; note = Candidatus Andersenbacteria bacterium
gtcagcctagctgaaccgctgtcgaggttctgtgccgggtgtatagccaggccgttttgcattgatcgacatcgtcgttacgaatccctcggggttcgcctaacgtcgaaccccgagggattcgtctcgtccaagtaggtgaca

SEQ ID NO: 17235 - RNA, 162 nt, unidentified
  source 1..162: mol_type = other RNA; note = Related to QFOJ01000011.1; note = Pseudoxanthomonas spadix
gccacttagctgggccctactcagagcataagcttcgataagggttctgtgccgggcgtatagccaggccgattgaattgaacgacatcgtcgcggcgaattcctctggaatccgcctagcgtcgaattccagaggaattcgcctcgtctcagtaggtggca

SEQ ID NO: 17236 - RNA, 176 nt, unidentified
  source 1..176: mol_type = other RNA; note = Betaproteobacteria bacterium; note = Related to JACPTK010000096.1
gcctcttagctgagcatctgtagaaggacgaagaataagcagttgctcttggccgggtgtatagccaggccgaactgaattgcgttagattctctggcgatttagcagaaaaagcggaatcgcctgagggcgattcagctttttctgctaaatcgccacgcctcaagtaagagggc

SEQ ID NO: 17237 - RNA, 162 nt, unidentified
  source 1..162: mol_type = other RNA; note = Proteobacteria bacterium; note = Related to CP053449.1
atcctttagttgagtttgtaaaaattaaatactgactctgttgccgggtgtatagctaggccgttctggattgagtggcatgttccgacaattaaagtgtcgcgtcatgcctctgcgagacatgccacgacactttaattgtcgtatcttaggtaagggatt

SEQ ID NO: 17238 - RNA, 163 nt, unidentified
  source 1..163: mol_type = other RNA; note = Betaproteobacteria bacterium; note = Related to JACQAP010000013.1
gtctcttagttgggcttgttcggtttttaattcgaataatgctcttggcccggtgtaccgccaggccgaattatattgcgcgagactctttgggcaggtttcccagcccgagagctcctcgctctcgggctgggaaacctgcccacgctctgagtaagagaca

SEQ ID NO: 17239 - RNA, 163 nt, unidentified
  source 1..163: mol_type = other RNA; note = Related to SCTX01000106.1; note = Betaproteobacteria bacterium
gtctcttagttgggcttgttcggttttctgttcgaatgacgctcttggcccggtgtacagccaggccgaattatattgcgcgagactctttgggctggtttcccatcccgagagctcctcgctctcgggctgggaaaccagcccacgctcttagtaagagaca

SEQ ID NO: 17240 - RNA, 161 nt, unidentified
  source 1..161: mol_type = other RNA; note = Related to JAIQGJ010000086.1; note = Acidobacteriia bacterium
gcgtcttagctgggtttttcgtgaaatctgcgacagaacctaacgccgggtgttcagccaggctgatttgcattgaacgggattctttgggcggcgaggcaaatccgtcctggagtcccaggacggatttgcctctccgcccaacgcttgagtaagacgca

SEQ ID NO: 17241 - RNA, 169 nt, unidentified
  source 1..169: mol_type = other RNA; note = Related to DQSS01000385.1; note = Arcobacter sp.
tttcctagtttggcttaaaaatatttattaataattaagcttgtgccaggtgtatagccttggtcggattaaattgttacacattgcttgcgaagttctaattttagctctttgcaacatgcgttacaaagagctaaaattagaacttcgcatcttaaaagtaggagcc

SEQ ID NO: 17242 - RNA, 164 nt, unidentified
  source 1..164: mol_type = other RNA; note = Related to JAIZOJ010000089.1; note = Sulfurovum sp.
cttcctagtttggcttaaaaatatttttttattaagcttgtgccaggtgtatagccttggtcgaattaaattgtacacattgcttgcgaagttctaattttagctctttgcaacatgcgttacaaatatctaaaatcagatcttcgcatcttaaaagtaggagc

SEQ ID NO: 17243 - RNA, 156 nt, unidentified
  source 1..156: mol_type = other RNA; note = Related to CP021072.1; note = Aliarcobacter cryaerophilus
actttttagctggcttaaatctaattttgattaaagcttgtgcctgatgattaatcaggtcgaattatattgatggtattggctgcagaaatttaaataaattctcagctccatccgaatcagagaatttatttaaatttctgcatcttaaaagta

SEQ ID NO: 17244 - RNA, 151 nt, unidentified
  source 1..151: mol_type = other RNA; note = Proteobacteria bacterium; note = Related to CP053451.1
gtctcttagctgggcatttcgtttggtacatcaaatgctctatgccgggtgtttagccaggctgaattgtattgattgacattcttgggcgggaattgatttcccgctgctcgcgggaagtcaattcccgccccgcttcgtgtaagagaca

SEQ ID NO: 17245 - RNA, 158 nt, Chromobacterium sp.
  source 1..158: mol_type = other RNA; note = Related to JAFBBB010000001.1; note = Chromobacterium violaceum
gcttcttagctgagttcctagctttaaagcaattctggaactctatgccgggtgtatagccaggctggtaaaaattgatatacattgcgggcgattttaagcataaatcgcctagcggcgatttatgcttaaaatcgccagcacttgtgtaagaagct

SEQ ID NO: 17246 - RNA, 164 nt, unidentified
  source 1..164: mol_type = other RNA; note = Related to JACRMO010000001.1; note = Gammaproteobacteria bacterium
gcctcttagcttggtatttgctcaaagggaaaagtgagcagatgcttaatgccgggtgtaaagccaggctgaattgcattgattggtattctacggcgggttttcacccgcctcatcgtaccgctgagtcgggtgaaaacccgccgcgctctgagtaagaggct

SEQ ID NO: 17247 - RNA, 146 nt, unidentified
  source 1..146: mol_type = other RNA; note = Thiotrichales bacterium; note = Related to JAFGUG010000057.1
agctcttagtctttgagcaataaatttatattgctatgtcaggcgaatcgctagacatttatcgttaattccatctgggccgacttcaaattgaagttccgctccgcaaaacttcaatttgaagtcgtgcattattgtaagagcta

SEQ ID NO: 17248 - RNA, 174 nt, unidentified
  source 1..174: mol_type = other RNA; note = Related to WGNH01000025.1; note = Alphaproteobacteria bacterium
ttctcttagcgatatgcgtggtcttacctcgcattgccgggcgatgcgccaggtatctttgattgtgtgcactgcagcgccgatttctcgcaaaatcgtcgtctttggtcgctccacaatcgctcctcaaagacgccaatttcgcaagaaatcggccgctctaagtaagagaca

SEQ ID NO: 17249 - RNA, 174 nt, unidentified
  source 1..174: mol_type = other RNA; note = Related to FNEQ01000013.1; note = Duganella sp.
tcaattacgcgttttgatggtcaaattcacttggtcattaatgtcgggcgtttcgccagactgatgagattgttagcactgacagcgcagaaagccgcacgcagcccggactgcaacctctcggttttgccgtgccgcgtacgtcttcctgcgctgtgttcaatggtagttgag

SEQ ID NO: 17250 - RNA, 176 nt, unidentified
  source 1..176: mol_type = other RNA; note = Related to NZ_WWCJ01000015.1; note = Massilia guangdongensis
tcaattacgcgtttgatgatcgctaatattgcttgatcattaatgtcgggcgtttcgccagactgtcttgattgtttgcactggcagcgcagaaagccgcgcccggcccggactgcgggctggcgcccttgccgtcccgtgcacgtcttcctgcgctgttttcaatggtagttgag

SEQ ID NO: 17251 - RNA, 157 nt, unidentified
  source 1..157: mol_type = other RNA; note = Related to JABXFH010000020.1; note = Janthinobacterium sp.
tcaattacgcgttttgatggtcatttttcttggtcattaatgtcgggcgtttcgccagactgattagattgttagcattgacagcgcagaaagccgcacgcggcacggcgcgccgtaccgcgcacgcctttctgcgctgtgtttaatggtagttgag

SEQ ID NO: 17252 - RNA, 180 nt, unidentified
  source 1..180: mol_type = other RNA; note = Related to AHJE01000051.1; note = Cupriavidus basilensis
tcaattacgcgttttggtggtcattgactaaccttcgatgatcattaatgtcgggcgtttcgccagactgttcgaattggcggcatttacagcgcagagaggcccacgcggcccggctgcgtacacttgtacttgccgcgccgcgcgggcctctctgcgccgtactccaaggtagttgag

SEQ ID NO: 17253 - RNA, 177 nt, unidentified
  source 1..177: mol_type = other RNA; note = Related to NZ_JACOGA010000020.1; note = Undibacterium flavidum
tcaattacgcgtttcgatggtcgtatatatctcttgatcattaatgtcgggcgtttcgccagaccgaatttaattgttagctttaacagcgtagaaacccccgagcgccgtgcccgcgtcgcgagctcctagtcccgtcgcccggtgatttctacgctgttataaatggtagttgag

SEQ ID NO: 17254 - RNA, 160 nt, unidentified
  source 1..160: mol_type = other RNA; note = Related to JABFMQ010000002.1; note = Herbaspirillum sp.
tcaattacgcgttttgatgttcaagcatatttctggacattaatgtcgggcggagcgccagactgaatgaattggtaccactgacagcgcagaaagccgcgcccgtcccggctcgccgcgacgaacacgccttcctgcgctgtaatttatggtagttgag

SEQ ID NO: 17255 - RNA, 186 nt, unidentified
  source 1..186: mol_type = other RNA; note = Related to NZ_JABUXU010000010.1; note = Advenella sp.
ccaattacgcgtttcgttggctactgacattggtgtctgcaagctgataatgtcgggcgtatcgccagactgaaaaggattggcagcatttttggcgcaaagacggtcgcgcgtcccagctcctccgcatgtctgctcctccgccgggccacgcgaccgtcttcgcgccatatttaggtagttggt

SEQ ID NO: 17256 - RNA, 186 nt, unidentified
  source 1..186: mol_type = other RNA; note = Related to NZ_CP089848.1; note = Paralcaligenes sp.
ccaattacgcgtttcgttggctgctgactgaattgtctgtgagctgataatgtcgggcgtatcgccagactgaaaaggattggcagcatttttggcgcaaagacgctcacgcgtcccagctcctccgcatgaatgctcctccgccgggccacgcgaccatcttcgcgccatatttaggtagttggt

SEQ ID NO: 17257 - RNA, 171 nt, unidentified
  source 1..171: mol_type = other RNA; note = Related to QTOY01000016.1; note = Burkholderia stagnalis
tcaattacgcgttttgttgatctagcgttgtctggatcaataatgtcgggcgattcgccagactgtcgacgattggggacacttacggcgcagagcggcccgcgcggcccagccggggtgctcccgtccgggccgcgcggaccgctctgcgccaaatcaagggtagttgag

SEQ ID NO: 17258 - RNA, 176 nt, unidentified
  source 1..176: mol_type = other RNA; note = Related to CAKMAA020000066.1; note = Candidatus Nitrotoga sp. HW29
tcagttacgcgtattgtggttattagtttaattaataatccattgtcgggcgaatcgccagacagcaaatgattgtgtgacatcgacggcacgaagaaggccccgcgcccaatcggctccgttgtcactcgcttgggcccgtgaccttcttcgtgcctgtaatttaggtaactgag

SEQ ID NO: 17259 - RNA, 175 nt, unidentified
  source 1..175: mol_type = other RNA; note = Related to NZ_QYUN01000002.1; note = Noviherbaspirillum sp.
tcagttacgcgacttgtggttgttggtaaaacgacatgccatcgtcgggcgcatcgccagacggaaaatgattgaacgacattggcggcacgaaaacggccacgcgcccaatctgctcctttgtcgcatcttgggcgcgtgtccattttcgtgcctgtaattcaaggtagctgag

SEQ ID NO: 17260 - RNA, 183 nt, unidentified
  source 1..183: mol_type = other RNA; note = Related to NZ_CP031704.1; note = Solimonas sp.
tcagttacgcgtatctgtggttgttagtaatttaacgccattgtcgggcgtatcgccagacagtagttgattgagcgacatcgacggcacgaaggcgcaggcgcgcccaatctgtcccttcgctgtcgctcgtgttgattgggcgcgcctgcgccttcgtgcctgtagttcaaggtagctgag

SEQ ID NO: 17261 - RNA, 176 nt, unidentified
  source 1..176: mol_type = other RNA; note = Related to NZ_ARWF01000001.1; note = Methylotenera sp.
tcagttacgcgtattgtggttgttagtaatctaacgttaccattgttgggcgaatcgccagacagtaaatgattgagtgacatcggaggcacgaagaaggccgcgcgcccaaaccgctcctatgtcgctcctttgggcgcgcggccttcttcgtgcctgtaatttaggtagctgag

SEQ ID NO: 17262 - RNA, 168 nt, unidentified
  source 1..168: mol_type = other RNA; note = Related to JAGKSE010000017.1; note = Acidovorax sp.
tcagctacgcgtttgtggtgaaggtaactagccatcgtcgggcgatttgccagacggaaatagattgagtgacatcgacggcacgaaaccggccctgcggccactcgcgccaagtctgtcacgagtggccgcaggtccggtttcgtgcctgtaatcagggtatctgag

SEQ ID NO: 17263 - RNA, 149 nt, unidentified
  source 1..149: mol_type = other RNA; note = Related to JAGOGO010000002.1; note = Deltaproteobacteria bacterium
gctctttagaggataagcagtttttaggctttgtccggcgttccgctggacttttacggattgataacacttaccggcatggtggccttcctcggctcaccgtcggtaagccgaggaaggccaccatgcctgcctctaagtaaagagca

SEQ ID NO: 17264 - RNA, 165 nt, unidentified
  source 1..165: mol_type = other RNA; note = Desulfobacterales bacterium; note = Related to JACRDD010000019.1
gctctttagcgaaataaactaagttagattagttttgtctggcgcttcgccggacttgcacctattgatggcatttattggcgcggtaggccgctttggctcaccggcccgttccgcgccgataagccaaagcggcctaccgcgccgcgctctgagtgaagagct

SEQ ID NO: 17265 - RNA, 108 nt, unidentified
  source 1..108: mol_type = other RNA; note = Related to VRUF01000040.1; note = Planctomycetes bacterium
gctctttagcgaagtaagcaagtaagtcgctttgtctggcgttccgtccggacttacacgaattggtaacacttatcggcacgcaggcctccatctaggtaaagagtt

SEQ ID NO: 17266 - RNA, 169 nt, unidentified
  source 1..169: mol_type = other RNA; note = Deltaproteobacteria bacterium HGW-Deltaproteobacteria-13; note = Related to PHBJ01000028.1
gctctttagtgtactaagcattattaattaggctttgtcgggcgcttcgccagactttcacgaattgcttccgtttatcggtatgggatgcccgctgcggctcaccgaatataccgatattcggcaagccgcagcgggcatcccatacctcgctcaaaagtaaagagta

SEQ ID NO: 17267 - RNA, 155 nt, unidentified
  source 1..155: mol_type = other RNA; note = Related to VGGK01000004.1; note = Chlorobi bacterium
gctctttagtgttataagctgttgtatcttttggctttgtccggcgcttcgccagacttttaactattgctagcatttaccggcacgtgagaccgctttggctcaccgctggtaacccaaagcggtctcacgtgccgttttttaagtaaagagca

SEQ ID NO: 17268 - RNA, 178 nt, unidentified
  source 1..178: mol_type = other RNA; note = Related to NZ_LT907975.1; note = Pseudodesulfovibrio profundus
gctctttagcggaattgtcggtcaattgccgaaaggtttaagccgtcgtgtcgggcgctccgccagaccaattgttattgtgagcatttagcggcaaataaggacgcgcttttctcctccgtcgctagctcctacgtagaaaagcgcggccttatttgcctcgctcaagtaaagggca

SEQ ID NO: 17269 - RNA, 151 nt, unidentified
  source 1..151: mol_type = other RNA; note = Related to MEKZ01000132.1; note = Acidobacteria bacterium RIFCSPLOWO2_12_FULL_60_22
ctctttacgcggttgagactttcgggtctcagcgtccggcgattcgccggacccagtattgattggtaactcttatcggcacgggtcgagaaaatctcgacaagcgtgtcgagattttctcgacacgtgccttcgctcaaaggtaaagagc

SEQ ID NO: 17270 - RNA, 171 nt, unidentified
  source 1..171: mol_type = other RNA; note = Related to FUZY01000002.1; note = Burkholderia sp.
tcaattacgcgcggtagcagattctgtaccttgctatcaattgtcgggcgcttcgccagactgagctgcagtggattcttcaacggcacgaaaacggcctgcgccgaatccgtgtccagtgggtcccgattcggcgcaggccgttttcgtgcctaaattcaggtaattgat

SEQ ID NO: 17271 - RNA, 167 nt, unidentified
  source 1..167: mol_type = other RNA; note = Related to NZ_LMEK01000025.1; note = Variovorax sp.
tcaattacgcgtatcggtagcaggagctagctatcaatgtcgggcgcttcgccagactgaaatgcagtggactacaacaacggcacgaaatcggcatgcgccgaatccgtgtccggtaggtcccgattcggcgcatgccgctttcgtgcctaatttaggtaattgaa

SEQ ID NO: 17272 - RNA, 166 nt, unidentified
  source 1..166: mol_type = other RNA; note = Related to JAIZPW010000002.1; note = Burkholderia contaminans
tcaattacgcgcggtagcagatatttcgctatcaattgtcgggcgtttcgccagactgagctgcagtggactatattaacggcacgaaaccggcatgcgccgaatccgtgtccagtaggtcccgattcggcgcatgccggtttcgtgcctaatttaggtaattgac

SEQ ID NO: 17273 - RNA, 169 nt, unidentified
  source 1..169: mol_type = other RNA; note = Related to NZ_CADFAD010000001.1; note = Burkholderia gladioli
tcaattacgcgcggtagcagacattttttgctatcaattgtcgggcgtttcgccagactgagctgtagtggacttcaataacggcacgaaagcggcatgcgccgaatccgtgtccggtgggtcccgattcggcgcatgccgctttcgtgcctatcttcaggtaattgac

SEQ ID NO: 17274 - RNA, 136 nt, Alcaligenes faecalis
  source 1..136: mol_type = other RNA; note = Related to DOIE01000002.1
acaattacgcgcggtaacaagttgctttgttatcaattgtcgggcgtttcgccagactgagctgtagtggattacatcttcggcacgaaaaaggcataggcctatgcctttttcgtgcctaatttaggtaattgac

SEQ ID NO: 17275 - RNA, 169 nt, unidentified
  source 1..169: mol_type = other RNA; note = Related to CP063848.1; note = Massilia sp.
tcaattacgcgaacggtagcaggtaataatagctatcaatgtcgggcgtttcgccagactgagaacaggtgggataccaaccacgacacgaaagcggcccgcgccaaatccgtgtccggtaggtcccgattcggcgcgagccgctttcgtgtctatttaggtaattgag

SEQ ID NO: 17276 - RNA, 170 nt, unidentified
  source 1..170: mol_type = other RNA; note = Related to NZ_WWCS01000001.1; note = Duganella margarita
tcaattacgcgaacggtagcagttggttatagctatcaatgtcgggcgcttcgccagactgagaacaggtgggaaaccaatcacgacacgaaagcggctcgcgccaaatccgtgtccggtaggtcccgattcggcgcgagccgctttcgtgtctattttaggtaattgag

SEQ ID NO: 17277 - RNA, 170 nt, unidentified
  source 1..170: mol_type = other RNA; note = Related to WNKY01000030.1; note = Duganella radicis
tcaattacgcgaacggtagcttagatgtagggctatcaatgtcgggcgtttcgccagactgagtacaggtgggatatcaatcacgacacgaaagcggcttgcgccaaatccgtgtccggtaggtcccgattcggcgcaagccgctttcgtgtctatattaggtaattgag

SEQ ID NO: 17278 - RNA, 166 nt, unidentified
  source 1..166: mol_type = other RNA; note = Related to PEFN01000001.1; note = Janthinobacterium sp.
tcaattacgtgagcggtagcaaaaaaggctatcaatgtcgggcgcatcgccagactgagtacaggtgggacatcaatcacgacacgaagacggcttacgccaaatccgtgtccggtgggtcccgattcggcgtaagccgtcttcgtgtctattcaaggtaattgat

SEQ ID NO: 17279 - RNA, 167 nt, unidentified
  source 1..167: mol_type = other RNA; note = Related to JACPYR010000019.1; note = Nitrosomonadales bacterium
tcaattacgtgtagacggtagcttattcttgttggctatcaattgtcgggcgcttcgccagactgggttgcagtggattcatctacagcacgaaatcgaaaattttcgtttcgtgctatgcccgaatcgaaaattttcgatttcgtgcttaattcaaggtaattgat

SEQ ID NO: 17280 - RNA, 167 nt, unidentified
  source 1..167: mol_type = other RNA; note = Related to MGWP01000046.1; note = Gallionellales bacterium GWA2_55_18
tcaattacgtgtagacggtagctcatttcgttggctatcaattgtcgggcgtttcgccagactgggttgcagtgtagtgtatcaacggcacgaaatcgcaatttttagtttcgtgctgcgcccgaatcgaaaaatttcgatttcgtgcctaattcaaggtaattgat

SEQ ID NO: 17281 - RNA, 175 nt, unidentified
  source 1..175: mol_type = other RNA; note = Related to NZ_JQKP01000004.1; note = Ferriphaselus sp.
tcaattacgtgaatggtggcaagttgtttcagctatcaattgtcgggcgtttcgccagactgagttgcagtggagtgcatcaacggcacgaaatcgaaagttttcgattcgggctagatgcagaagcgcccgaatcgaaaactttcgatttcgtgcctaatttaaggtaattgat

SEQ ID NO: 17282 - RNA, 166 nt, unidentified
  source 1..166: mol_type = other RNA; note = Related to NZ_ARWC01000001.1; note = Methylotenera sp.
tcaattacgcgaaggtggcttttgtattggctatcaatgtcgggcgtttcgctagactgaattgcagtggattataatttacagcacgaatccaaaatttttgtatcgtgcaaaatgcagcccaatccaaaaattttggattcgtgcttaatttaaggtaattgaa

SEQ ID NO: 17283 - RNA, 167 nt, unidentified
  source 1..167: mol_type = other RNA; note = Rhodocyclaceae bacterium; note = Related to SSDX01000104.1
tcaattacgcgttggatagcttggtttgaggctatcaattgtcgggcgtttcgccagactgagtttgagtggacttcatctacggcacgaaatcggcctggccgaattcgcgccgttggctccgaattcggccaggccgatttcgtgcctagttcaaggtaattgat

SEQ ID NO: 17284 - RNA, 166 nt, unidentified
  source 1..166: mol_type = other RNA; note = Related to NZ_CP073754.1; note = Methylomonas paludis
tcaattacgcgttgatagttcttccaaataagactatctgtgtcgggcgattcgccagaccgtacttaagtgggacaccatctacgtcatgaattcggcctcgccgaactcgtgcggtggctcaatttcggcgaggccgaattcatgactatttaaggtaattgat

SEQ ID NO: 17285 - RNA, 138 nt, unidentified
  source 1..138: mol_type = other RNA; note = Related to NZ_NWMV01000032.1; note = Macromonas sp.
tcaattacgcgtttggtagcagtcaaagtaaggcgctatctgagtcgggcgattcgctagaccgcaatgaggtgtacgtcatcaacgacacggaaacggccccggggccgtttccgtgtctattcaaaggtaattgac

SEQ ID NO: 17286 - RNA, 170 nt, unidentified
  source 1..170: mol_type = other RNA; note = Related to NZ_CP009962.1; note = Collimonas arenae
ctgtctacgcgtgatagcgcacccagctattaatgtcgggcgattcgccagactgtactgtattgagcagatttgacggcacggaattggcccaaaacccactccgcttccgcttcgcttctgctccatgggttttgggccaattccgtgcctaggtcaaggtagatact

SEQ ID NO: 17287 - RNA, 164 nt, unidentified
  source 1..164: mol_type = other RNA; note = Related to NIQA01000002.1; note = Pusillimonas sp.
tcaattacgcgtaggtagcctcaactacagggctatcaatgtcgggcgattcgccagactgtattgcagtggatatattttacgaggcaaaaccggcttggccggagagcctcgacactcggctctccggccaagccggttttgcctctatcaaggtaattgaa

SEQ ID NO: 17288 - RNA, 176 nt, unidentified
  source 1..176: mol_type = other RNA; note = Related to NZ_OU745373.1; note = Cardiobacterium sp.
ctaattacgcgttatttgatgactttgttttaaataatttagtcatctatgtcgggcgcatcgctagactgaatattaattgtgtcatttgtggcgagtttggaaagaaaattccgagctgtcataaatgacaactcggaattttctttccaaactcgctaattatggtagttagt

SEQ ID NO: 17289 - RNA, 156 nt, unidentified
  source 1..156: mol_type = other RNA; note = Related to CP005967.1; note = Haemophilus influenzae
ctaattacgcgttttggtagaaaattctatctattgtcgggcgaatcgccagactgaatattaattgtttccaattgtggcgagataaaggaaaaatttccgcccgcctcgctacacggaaatttttcctttatctcgctcatttaggtagttagt

SEQ ID NO: 17290 - RNA, 172 nt, unidentified
  source 1..172: mol_type = other RNA; note = Related to LUAO01000054.1; note = Neisseria sp.
ctaattacgcgtttttggatgattgaatttaaatttagtcgttcatagtcaggcgtttcgctagactgaatattaattgactacatctccgcgagaattcgggctttctcccgccttctcgttagagaagtcgggagaaagcccgaattctcgcttaatttaggtagttagc

SEQ ID NO: 17291 - RNA, 168 nt, unidentified
  source 1..168: mol_type = other RNA; note = Related to NZ_LXSJ01000026.1; note = Eikenella corrodens
taatctacgcgaatatgatggtctgtaataagatatgatttttatggttcatcaattgtcaggcgtaatcgctagactgaatctgaattgattccgatctcggcgggaaatatttccattttcctgctgggaaaatggaaatatttcccgctaatttaggtagttagt

SEQ ID NO: 17292 - RNA, 140 nt, unidentified
  source 1..140: mol_type = other RNA; note = Related to NZ_LPEB01000197.1; note = Burkholderia ubonensis
tcaattacgcgatcggtagccaacagctatcaatgtccggcgtttcgcaggactgcgcttgggtggacggcgtcaacggcacgaattccgtgtccggcgagccggacacggaattcgtgcctaacttcaaggtaattgag

SEQ ID NO: 17293 - RNA, 140 nt, unidentified
  source 1..140: mol_type = other RNA; note = Related to CABVPW010000018.1; note = Burkholderia lata
tcaattacgcgatcggtagcaaacggctatcaatgtccggcgtttcgcaggactgcgcttgggtggacggcgtcaacggcacgaagtacagggccggcgagccgtccctgtacttcgtgcctaaattcaaggtaattgag

SEQ ID NO: 17294 - RNA, 140 nt, unidentified
  source 1..140: mol_type = other RNA; note = Related to NZ_JAELTS010000025.1; note = Paraburkholderia sp.
tcaattacgcgatcggtagccaacagctatcaatgtccggcgtttcgcaggactgcgcttgggtggacggcgtcaacggcacgaagtacagggccgtcgagccggccctgtacttcgtgcctaaattcaaggtaattgag

SEQ ID NO: 17295 - RNA, 139 nt, unidentified
  source 1..139: mol_type = other RNA; note = Related to NZ_SNVI01000005.1; note = Paraburkholderia dipogonis
tcaattacgcgatgggtagctaagagctatcaatgtccggcgtttcgcaggactgcgtttgggtgggcgacatcaacggcacgaatttcgcgtccggcgagcggccacaaaatccgtgcctaacttcaaggtaattgag

SEQ ID NO: 17296 - RNA, 141 nt, unidentified
  source 1..141: mol_type = other RNA; note = Related to CP007783.1; note = Burkholderia cenocepacia
tcaattacgcgatcggtagcagtagctatcaattgtccggcgtttcgcaggactgcgtttgggtggacggcatcaacggcacgaagtacggtgtcggacgagccgacaccgtacttcgtgcctaaattcaaggtaattgag

SEQ ID NO: 17297 - RNA, 139 nt, Nitrosomonas sp.
  source 1..139: mol_type = other RNA; note = Related to QWIC01000028.1
tcaattacgcgattggtagttagcaactatctatgtccggtgtttcgcaggactgcgcttgagtggatggcatcatcggcacaaaatacaaggccgaaaagccgtccttgtattttgtgcctaatttaaggtaattgat

SEQ ID NO: 17298 - RNA, 141 nt, unidentified
  source 1..141: mol_type = other RNA; note = Related to CP001132.1; note = Acidithiobacillus ferrooxidans
ctcaattagcgtctgatagattcgtctatcaatgtccggcgtatcgcaggactgagttgagttgcacggcatctacggcacggagacccgtgccggcgagccgtcacgggtctccgtgcctacagtcaaaggtaattgaga

SEQ ID NO: 17299 - RNA, 158 nt, Chromobacterium sp.
  source 1..158: mol_type = other RNA; note = Related to NZ_MKCR01000001.1; note = Chromobacterium amazonense
tcaattacgcgtttggtagcttagctgcctcagcagtgtgcaagctatctattgtccggcgtttcgcaggactgagttgtggtggagggcatcaacgacacgaagatcggtgtcggacgagccgacaccgatcttcgtgtctattaaaggtaattgag

SEQ ID NO: 17300 - RNA, 146 nt, unidentified
  source 1..146: mol_type = other RNA; note = Related to CP045571.1; note = Acidithiobacillus thiooxidans
tcagctacgcgttttggtagtcaactgtagaactatcaactgtccggcgtttcgcaggactgcggtgtggtggatcgcaattacggctcgaaaagccgcgatggcgagccatcgcaacttttcgagtctagtttaaggtagttgag

SEQ ID NO: 17301 - RNA, 138 nt, unidentified
  source 1..138: mol_type = other RNA; note = Related to NZ_CP012371.1; note = Nitrosospira briensis
tcaattacgcgttttgataggtaatctatcaatgtcgggcgtttcgccagactgagctgtagtggagggcatcattggcacaaaatccggcgccggtgcccgtcaccgtatttcgcgcctagcttcaaggtaattgag

SEQ ID NO: 17302 - RNA, 139 nt, unidentified
  source 1..139: mol_type = other RNA; note = Related to JABFSF010000055.1; note = Methylotenera sp.
tcaattacgcgtttgatagattatttctatctatgtcgggcgtttcgctagactgagttgtagtggatggcatcattggcacaaaatacagtgctggcgagccatcactgtattttgtgccgatcttaaggtaattgat

SEQ ID NO: 17303 - RNA, 138 nt, unidentified
  source 1..138: mol_type = other RNA; note = Burkholderiales bacterium; note = Related to JACPOI010000036.1
tcaattacgcgttttggtagcttgtctatcaatgtccggcgcttcgcaggactgcgtataggtggagagcttcaacggcacgaaaaagtcgtccgcaagctccctttgtttttcgtgcctacgatcaaggtagttgag

SEQ ID NO: 17304 - RNA, 140 nt, unidentified
  source 1..140: mol_type = other RNA; note = Related to NZ_PVLR01000019.1; note = Malikia spinosa
tcaattacgcgaatggtagttttaagactatcaatgtccggcgtttcgcaggactgagctgtagtggatggcatcatcggcacggaatacgtggctggcgagccagccacgtattccgtgcctaattaaaggtaattgaa

SEQ ID NO: 17305 - RNA, 160 nt, unidentified
  source 1..160: mol_type = other RNA; note = Related to NZ_AP022673.1; note = Sphingomonas sp.
ccatttacgcgttaagcccctcgttggggtgtctggcgtttcgctggacgtaattcgattgccgagttttatcggtgcgaaagagggtgatgtctcatcgccttcggccgctacgctcgataagacatcaccctctttctcaccttcacaggtaaatggc

SEQ ID NO: 17306 - RNA, 161 nt, unidentified
  source 1..161: mol_type = other RNA; note = Related to NZ_CP016456.1; note = Sphingobium sp.
ccatttacgcgtatcgccctttttagggtgtgtctggtgtttcgctggacctaatttgattgccgagttttatcggtgcgaaagagggtgatgtctcatcgcctccggtcgctacgctcgataagacatcaccctctttctcaccttcacaggtaaatggt

SEQ ID NO: 17307 - RNA, 161 nt, unidentified
  source 1..161: mol_type = other RNA; note = Sphingomonadales bacterium; note = Related to JADKHG010000002.1
ccatttacgcgtttagtaccatttggtgctcgtccggcgtttcgctcgacgtcatttgattgtgcagttttatcgttgcgactgagtgcgatgtctcatcgcctcacggacgctacgctcgataagacatcgcactcagtcgcaacttctaggtaaatggc

SEQ ID NO: 17308 - RNA, 170 nt, unidentified
  source 1..170: mol_type = other RNA; note = Related to APMP01000001.1; note = Caulobacter vibrioides
ccatttacgcgttctagcgttcctgtcggaacgtgagtctggcgcttcgccggacttaaattgattgtagactcttatcggtgcggaagagggttatgtctcatcgcctcgatgaggccgctacgctcgataagacataaccctcttcctcaccttcacaggtaagtggc

SEQ ID NO: 17309 - RNA, 169 nt, unidentified
  source 1..169: mol_type = other RNA; note = Related to JADPJG010000026.1; note = Bradyrhizobium sp.
ccacctacgcgttggtctttcctttccgaagggaagatagtcgggcgtttcgccggacttagtttgattgcgcagtcttatcggtgcggaagagggagatgtctcatcgccttcggacgctacgctcgataagacatctccctcttcctcacctttaagggtaagtggc

SEQ ID NO: 17310 - RNA, 173 nt, unidentified
  source 1..173: mol_type = other RNA; note = Related to JAFWCE010000141.1; note = Loktanella sp.
ccacctacgcgaaaaggcgttaaaatgacttttacgcctgtcaggcgtttcgccagacatattttgattgactacatttatcggtgcggaagacggctagaactcatcgtctgttccagaccgctacgctcgataagttctacccgtcttcctcacctgagaaggtaagtggt

SEQ ID NO: 17311 - RNA, 175 nt, unidentified
  source 1..175: mol_type = other RNA; note = Related to NZ_PHSI01000091.1; note = Cereibacter azotoformans
ccacatacgcgagtcggcgcatgaaacagagtgattgcgctcgtctggcgtttcgccggacgtaaactgattgttgggatttatcggtgcggaatacgatgaggactcatcgcctctgcgaggccgctacgctcgataagtcctcatcgcattcctcaccttcaaggtaagtggc

SEQ ID NO: 17312 - RNA, 172 nt, unidentified
  source 1..172: mol_type = other RNA; note = Related to NZ_CP039435.1; note = Brevundimonas sp.
acacttacgtgattagcactcgttgtgcttggtccagcgctatcgctgagatctaagttgattggcaggttttatgggccacggaagatcgcgccatttccgcgtcattcgtgttctcatgtccgctgcgctcgcggaaatggcgcgatcttccgtgtcctaggtaagtgtt

SEQ ID NO: 17313 - RNA, 160 nt, unidentified
  source 1..160: mol_type = other RNA; note = Related to NZ_JAKRET010000004.1; note = Sphingomonas sp.
tcgcttacgcgaacagaccgttttacggttggtccggtgtttcgctggatcgtacattattggtcaaatctgggtgccccagacggacgaagcattcgtccgcctgtgggccactccgttcggtcgaatgcttcgtccgtctggggcttaggtaagcaaa

SEQ ID NO: 17314 - RNA, 160 nt, unidentified
  source 1..160: mol_type = other RNA; note = Related to JALHLF010000113.1; note = Novosphingobium sp.
aagcttacgcgaaatggctgtgaaacagctggtctggtgcttcgccggatctcaaatgattggtaacttttaggtgctccgaacgggcgatggtttcgaccgccttacggacgctccgctcggtcgaaaccatcgcccgttcggagcttaggtaagcaat

SEQ ID NO: 17315 - RNA, 161 nt, unidentified
  source 1..161: mol_type = other RNA; note = Related to NZ_WMHO01000038.1; note = Sandarakinorhabdus rubra
atgcttacgcgagtaggccattaaattggctggtctggtgtttcgccagatcgaaatcgattggtaagttttatcggccccgaacggacgaagtactcggccgcccaggggccgctccgctcggccgagtacttcgtccgttcggggcttaggtaagcagc

SEQ ID NO: 17316 - RNA, 163 nt, unidentified
  source 1..163: mol_type = other RNA; note = Related to NZ_JACIJH010000001.1; note = Sphingopyxis panaciterrulae
gagcttacgcgattaagtgccggagacggtactttgtctggcgcttcgccagatatcacgtaattggtcaattctatgggccccgaacggacgaaggattcgtccgccaaaggccgctccgctcgtacgaatccttcgtccgttcggggcttaggtaagcaac

SEQ ID NO: 17317 - RNA, 189 nt, unidentified
  source 1..189: mol_type = other RNA; note = Related to DPST01000077.1; note = Erythrobacter sp.
aagcttacgcgactaggcgttggcaacaacgctgagtctggcggatcgccggacttcatttgattggttggattttggtgcccccgaatgggcgtgatggatcannnnnnnnnnnnnnnnnnnnnnnnnnnnnnnnnnnnnnnnnngggcgatgatccatcacgcccattcggggcttaggtaagtgac

SEQ ID NO: 17318 - RNA, 168 nt, unidentified
  source 1..168: mol_type = other RNA; note = Related to JABFWP010000009.1; note = Sphingomonas sp.
aagcttacgcgaatgagcaccgtaactggtgcttggtcgggcgtttcgccagacctcacattattgacctcaattaggggccccgaaagcccgcgatttcccatcgccccttcggggacgctccgctcgaatgggccctcacgctctttcggggcataggtaagcaga

SEQ ID NO: 17319 - RNA, 163 nt, unidentified
  source 1..163: mol_type = other RNA; note = Related to JADCAE010000108.1; note = Phenylobacterium sp.
ccacttacgcgttaagcgctctcgggtgcttggtccggcgcttcgccggatctcaatggtctgggaacatttattgccccgaaagagggcggtagatgatcgcctcccggccgctccgctcgatcacccaccgccctctttcgggtctcttgaggtaagtcag

SEQ ID NO: 17320 - RNA, 167 nt, unidentified
  source 1..167: mol_type = other RNA; note = Sphingomonadaceae bacterium LXI357; note = Related to JAGRQC010000004.1
cagcttacgcgacttggtgtcacgtttggatacccgtctggcggttcgccggacgtcacattattgggaatgcttggggctccgaaagagcgcgatggccaatcgccctcagtcgggacgctccgctcgattgcccatcgcgctctttcggagcataggtaagctgt

SEQ ID NO: 17321 - RNA, 168 nt, unidentified
  source 1..168: mol_type = other RNA; note = Related to NZ_CP054151.1; note = Agrobacterium vaccinii
tggcttacgtgtattgagtgcattgtctagcacttggtctagcgcttcgctggacctcattatattgcggaattttggtgccctgtaaggtagtgattgaacatcgcccttcgggacgctccgctcgataatcaatccctaccttacagggcttcaagggtaagctat

SEQ ID NO: 17322 - RNA, 168 nt, unidentified
  source 1..168: mol_type = other RNA; note = Related to FTMQ01000001.1; note = Rhizobium sp.
cggcttacgtgtattgagtgcgtcgtttagcacttggtctagcgcttcgctggacctcattatattgcggaattttggtgccctgtaaggtagcgattgaacatcgcccttcgggacgctccgctcgatagtcaatccctaccttacagggctttaagggtaagctat

SEQ ID NO: 17323 - RNA, 167 nt, unidentified
  source 1..167: mol_type = other RNA; note = Related to NZ_JACHEG010000009.1; note = Rhizobium wenxiniae
aggcttacgtgtcttgagtgcatattagcacttggtctagcgtttcgtctggacctcatcatattgcggaattttggtgccctgtaaggtagcgattgaacatcgcccttcgggacgctccgctcgataatcaatccctaccttacagggctttaagggtaagctat

SEQ ID NO: 17324 - RNA, 164 nt, unidentified
  source 1..164: mol_type = other RNA; note = Related to NZ_NWSV01000001.1; note = Rhizobium chutanense
acgcttacgtgcataagcgcttcgtgcgctggtctggcgattcgtccggacctcattatattgtcgagatttggtgccctagaaggtagcgattgccaatcgcccttcgggacgctccgctcgatagccattcactaccttctagggctttaaaggtaagcata

SEQ ID NO: 17325 - RNA, 164 nt, unidentified
  source 1..164: mol_type = other RNA; note = Related to NZ_JADNQW010000005.1; note = Methylosinus sp.
atgcttacgcgtaacgtgccgtcaggcacgtggcccggcgcttcgctaggtctaactttattgtcctcacttgcggcctcggaagacggctttgcgccatcgtccgtgggaccgctccgctcgatggcgcaaagccgtcttccgagtccttaaaggtaagcact

SEQ ID NO: 17326 - RNA, 162 nt, unidentified
  source 1..162: mol_type = other RNA; note = Related to NZ_JAEPIV010000062.1; note = Azospirillum sp.
atgcttacgcgtaaagtgccgaaaggcacttggccaggcgtttcgcccggtctaattttattgtccccacttgcggcctcggaagatggctttgggccatcgtcgaggaccgctccgctcgatggcccaaagccatcttccgagtccttaaaggtaagcaat

SEQ ID NO: 17327 - RNA, 167 nt, unidentified
  source 1..167: mol_type = other RNA; note = Related to NZ_VSTH01000095.1; note = Bradyrhizobium hipponense
acgcttacgcgaatgagcacatgctttcgtgcttggtcgggcgtttcgccagacctcatcttattgtcgagttttgttgccccggaagatagcaactcgctatcgcccttcgggacgctccgctcgatatcaagtcactatcttccgcggcttcaaaggtaagcttt

SEQ ID NO: 17328 - RNA, 168 nt, unidentified
  source 1..168: mol_type = other RNA; note = Related to RXJE01000056.1; note = Bradyrhizobiaceae bacterium
aggcttacgcgtttgagcactactaatgtgcttggtctggtgccttcgctggacctcaacttattgtcgacttttgggcgccccaaacgatagcgccacgctatcgcccaaggggacgctccgctcgatagcatgtcactatcgtttggggcttttagggtaagcagc

SEQ ID NO: 17329 - RNA, 160 nt, unidentified
  source 1..160: mol_type = other RNA; note = Related to NC_015976.1; note = Sphingobium sp.
gcgcttacgcggtaagcacttcggtgcttggtctggcgtttcgccagacatcattatattggctagttttttggccccacaagagagcgctgcgcgctcgcccatggggccgctccgctcgaacgcacagcgctctcttgtggggcttggggtaagcatt

SEQ ID NO: 17330 - RNA, 167 nt, unidentified
  source 1..167: mol_type = other RNA; note = Related to NZ_CP039695.1; note = Novosphingobium sp.
cagcttacgcgttttgggtgcctaacggcatctagtccgacgtttcgtttggacttcaaattattggtcacacttgtggctccggaagagtccgatacgagatcggctcttgcagagccgctccgctcgatctcgtatcggactcttccggagcataggtaagctat

SEQ ID NO: 17331 - RNA, 156 nt, unidentified
  source 1..156: mol_type = other RNA; note = Related to JAFVHE010000060.1; note = Sphingopyxis sp.
cagcttacgcgattagtgcttttgcgctggttcggcgcttcgccgaatctcaatttattgttcccatttggggccctgaaagagagcgatgcaaaatcgccacaggacgctccgctcgattttgcatcgctctcttccagggcctaggtaagctga

SEQ ID NO: 17332 - RNA, 160 nt, unidentified
  source 1..160: mol_type = other RNA; note = Related to NZ_CP011310.1; note = Aurantiacibacter atlanticus
ccgcttacgcgttaagcatcctcggatgcttggttcggcgctgcgccgaatctcatatcattggaaccaattggggctccgaaagagagcgatgcgaaatcgccttacggacgttccactcgattccgcatcgctctctttcggagcttaggtaagcaat

SEQ ID NO: 17333 - RNA, 167 nt, unidentified
  source 1..167: mol_type = other RNA; note = Related to NZ_CP092689.1; note = Gluconobacter frateurii
gtgcttacgcgtatggtgaaactaccaagcctcaccgtctggcgcttcgccagagttcatatgattgcccagttttcattgccggggagagaacttaggtctcatcgaccacaggctcgctccgctcaatgagacctaagttctctccccggctcaaggtaagcaat

SEQ ID NO: 17334 - RNA, 167 nt, unidentified
  source 1..167: mol_type = other RNA; note = Related to NZ_JAERLO010000011.1; note = Gluconobacter cerinus
gtgcttacgcgtatggtgaaaacactaaacttcgccgtccggcgcttcgccggacttcatatgattgttgggttattgttgccgtggagagaacttaggtcttatcgtcctaggggctcgcgctgctcgataagacctaagttctctccccggctcaggtaagcaat

SEQ ID NO: 17335 - RNA, 161 nt, unidentified
  source 1..161: mol_type = other RNA; note = Related to NZ_CP068419.1; note = Gluconobacter sphaericus
atgcttacgcgtatggtgaaaaaccaattcgccgtctggcgtttcgccggacttcaaatcattggtaggtttctttgccgaggacgaactgtaggtctcaccgaccttcggtcgctccgctcggtgagacctacagttcgtcctcggcttaggtaagcaat

SEQ ID NO: 17336 - RNA, 169 nt, unidentified
  source 1..169: mol_type = other RNA; note = Related to JAEULJ010000003.1; note = Altererythrobacter sp.
gcgcttacgcggttgagcatcttttgctcggtccggcgtttcgtccggacctcatatgattggctggttttatggcaccgaaagacagcgctgcgctgtttgccggtcgcttcgaccggccgctacgctaaacagcgcagcgctgtctttcggtgcttaggtaagctcc

SEQ ID NO: 17337 - RNA, 164 nt, unidentified
  source 1..164: mol_type = other RNA; note = Related to NZ_JAINWL010000001.1; note = Proposed Citromicrobium bathyomarinum
ctgcttacgcgattgagcaatggcctgctcggtctggcgcttcgccggacctcactagattggccggttttatggcaccgaaagacagcagcgcgctgtctcccggcaagccggtcgctccgctagacagcgcgctgctgtctttcggtgcttaggtaagccct

SEQ ID NO: 17338 - RNA, 168 nt, unidentified
  source 1..168: mol_type = other RNA; note = Related to QFOF01000021.1; note = Azospirillum brasilense
tcacttacgcgattggcactgtgtgaatgcattagtgctggtctggtgtttcgccggacctcattggattgataggttttacccggcgcggaagggagcggtgtcttaccgcctccggccgctccgctcggtaagacaccgctcccttccgcgcctcaggtaagtgat

SEQ ID NO: 17339 - RNA, 170 nt, unidentified
  source 1..170: mol_type = other RNA; note = Related to NZ_MLCO01000142.1; note = Roseomonas deserti
tcacctacgagagtggcactaaactatgaaacttagtgctggtctggcgcttcgccggatctcatttgattggcggcttttcccgggcgcggaaggacgcggtgtcttaccgtcctccggccgctccgctcggtaagacaccgcgtccttccgcgcctttggtaggtgtt

SEQ ID NO: 17340 - RNA, 160 nt, unidentified
  source 1..160: mol_type = other RNA; note = Methylobacteriaceae bacterium; note = Related to JACKJE010000004.1
ccgcttacgcgtatgcgccgaaaggcgcatggcccggtgtttcgctaggtctaagtttattgcggagttctgcggactcggaagatggcgacagcccatcgcccggggacgctccgctcgatggtctgtcgccatcttccgagtctcaaaggtaagcgct

SEQ ID NO: 17341 - RNA, 164 nt, unidentified
  source 1..164: mol_type = other RNA; note = Related to NZ_CP088280.1; note = Bradyrhizobium sp.
caacttacgcgataagcaccttgtgtgcttggtccgacgtttcgtcagacctcaattgattgctaggttttatccggtgtggaagaacgcgtggtcttaccgccacaagtggccgctccgctcggtaagaccccaccttcttccacacctccaaaggtaagtga

SEQ ID NO: 17342 - RNA, 165 nt, unidentified
  source 1..165: mol_type = other RNA; note = Hyphomicrobiales bacterium; note = Related to JAFKKC010000005.1
tagcttacgcgagaagcaccttgtgtgcttggtccgacgtttcgtcagacatcagtttattgattggttttatccggtgtggaagaacgtgtggtcttaccgccacaagtggcctctccgctcggtaagaccccacgttcttccacacctccaagggtaagtgat

SEQ ID NO: 17343 - RNA, 165 nt, unidentified
  source 1..165: mol_type = other RNA; note = Related to RJJT01000004.1; note = Rhizobium pisi
caccttacgcgagaagcaccttgtgtgcttggtccgacgtttcgtcagacctcaattgattggcaggttttatccggtgcggaagaacgcgtggtcctaccgccacaggtggccgctccgctcggtaaaaccccaccttcttccacacctccaagggtaaggtga

SEQ ID NO: 17344 - RNA, 165 nt, unidentified
  source 1..165: mol_type = other RNA; note = Related to NZ_FODE01000022.1; note = Paracoccus alcaliphilus
tagcttacgcgataagcaccttgcgtgcttggtcagacgtttcgtcagacctcaattgattgttaggttttatccggtgtgggtgcacgtgtggtcttaccgccacaagtggcctctccgctcggtaagaccacacgtacacccacaccttcgagggtaagtgat

SEQ ID NO: 17345 - RNA, 165 nt, unidentified
  source 1..165: mol_type = other RNA; note = Related to SRUN01000004.1; note = Mesorhizobium sp.
cagcttacgcgaaaggcacctcgtgtgcttggtccgacgtttcgtcagacctcatctgattgtcgggttttatgcggtgtggaataacgcgtggttctaccgccacaagtggccgctccgctcggtaaaaccccaccttatcccacacctccaagggtaagtgat

SEQ ID NO: 17346 - RNA, 164 nt, unidentified
  source 1..164: mol_type = other RNA; note = Related to WUFV01000007.1; note = Rhizobium leguminosarum
cagcttacgcgagaagcatctttggtgcttggtccgacgtttcgtcagacatcaattgattgataggttttatccggtgtggaacaacgtggtgtcttaccgccacaagtggccgctccgctcggtaaaacaccacgttattccacacctccaagggtaagtga

SEQ ID NO: 17347 - RNA, 164 nt, unidentified
  source 1..164: mol_type = other RNA; note = Related to RPJK01000002.1; note = Sinorhizobium medicae
cagcttacgcgagaagcacctgcggtgcttggtccgacgtttcgtcagacctcaattgattgataggttttatccggtgtggaatatcatggtgtcttaccgccacaagtggccgctccgctcggtaaaaccccacgttattccacacctccaagggtaagtga

SEQ ID NO: 17348 - RNA, 165 nt, unidentified
  source 1..165: mol_type = other RNA; note = Related to NZ_KI912610.1; note = Mesorhizobium ciceri
tagcttacgcgaaaagcactttttgtgcttggtccgacgtttcgtcagacctcaattgattgataggttttatccggtgtggaacaacgtggtgtcttaccgccacaagtggccgctccgctcggtaaaactccacgttcttccacacctccaagggtaagtgat

SEQ ID NO: 17349 - RNA, 164 nt, unidentified
  source 1..164: mol_type = other RNA; note = Related to NZ_WOAC01000018.1; note = Mesorhizobium sp.
cagcttacgcgagaagcacagttcgtgcttggtccgacgctccgtcagacctcaattgattgctaggttttttccggtgtggaacaacgcggtgtcttaccgccttgataggacgctccgctcggtaaaacccctcgttcttccacacctccaagggtaagtga

SEQ ID NO: 17350 - RNA, 165 nt, unidentified
  source 1..165: mol_type = other RNA; note = Related to JAJAVB010000031.1; note = Aurantimonas sp.
tagcttacgtgaaaagcgccttgcgcgcttggtccggcgtttcgtcagacctcagtcgattgttaggttttatccggtgtggaacaacctggggttctaccgccacaagtggccgctccgctcggtagaaccccagcttattccacacctccaagggtaagtgct

SEQ ID NO: 17351 - RNA, 161 nt, unidentified
  source 1..161: mol_type = other RNA; note = Related to NZ_MKIN01000018.1; note = Rhizobium taibaishanense
tcacttacgcgaagagcagtttttctgcttggtcgggcgcttcgccggacctcataatattggtaactcttttgttgcgcggaaggtttcgacgtctcgtcgtcttcagaccgcttccgctcgacaagacgtcgaaaccttccacgtcttaggtaagtgct

SEQ ID NO: 17352 - RNA, 164 nt, unidentified
  source 1..164: mol_type = other RNA; note = Related to JALBGV010000046.1; note = Neorhizobium sp.
acacttacgcgaagagcagattttctgcttggtcgggcgtttcgccggacctcacatcactggtaactcttttgttgcgtggaaggtttcgacgtcttgtcgtcttcagaccgcttccgctcgacaagacgtcgaaaccttccacgtcttcaaaggtaagtgct

SEQ ID NO: 17353 - RNA, 164 nt, unidentified
  source 1..164: mol_type = other RNA; note = Related to NZ_LANJ01000022.1; note = Devosia epidermidihirudinis
attcttacgcgaacagcagatcttctgcttggtcgggcgcttcgccggacctcaactcactgttagctcttttgttgcgcggaaggtttcgacgccttgtcgtcttacgaccgcttccgctcgacaagacgtcgaaaccttccacgtctccagaggtaagtgct

SEQ ID NO: 17354 - RNA, 164 nt, unidentified
  source 1..164: mol_type = other RNA; note = Related to NZ_CP013068.1; note = Pannonibacter phragmitetus
acacttacgcgaagagcagaatttctgcttggtcgggcgcttcgccggacctcatatcattggtaactcttttgttgcgcggaaggtttcgacgtcttgtcgtcttcagaccgcatccgctcgacaagacgtcgaaaccttccacgtcttcaaaggtaagtgct

SEQ ID NO: 17355 - RNA, 158 nt, unidentified
  source 1..158: mol_type = other RNA; note = Related to VRUZ01000039.1; note = Methylobacterium sp.
gcacttacgcgaaaagcactccggtgcttggtctagcgattcgctggatctaattcgattgagcactctttcccggcgtgaaggctcgttgtgccttgccgccgaaggacgctccgctcgtcaagtcacaacgagccttcacgccttaggtaagtgtt

SEQ ID NO: 17356 - RNA, 165 nt, unidentified
  source 1..165: mol_type = other RNA; note = Related to NZNS01000009.1; note = Parvibaculum sp.
atgcttacgcgaatgacaccttgtaatctggtgttagtctggcggttcgccagacatcagttgattgtctactcttattgccgcggaagtccgcggggccccatcgcccttcgggacgctccgctcgataagaccccgcggacttccgcgtcttaggtaagcgac

SEQ ID NO: 17357 - RNA, 159 nt, unidentified
  source 1..159: mol_type = other RNA; note = Related to NZ_LWMO01000047.1; note = Rhizobium anhuiense
gcacttacgcgaatggcatgtagcttggtcaggcgcttcgctagacctcactcgattggtttcctttttgcggctcggaaggttccaaagccttcccgcctcgttgaggacgctccgctcggcaagactttgcaaccttccgagcctttggtaagtgat

SEQ ID NO: 17358 - RNA, 160 nt, unidentified
  source 1..160: mol_type = other RNA; note = Related to JACHZB010000001.1; note = Rhizobium sp.
gcacttacgcgaatggcattttagcttggtcgggcgtttcgctagacctcactcgattggtttcctttttgcggctcggaaggttccaaagccttaccgcctcaatgaggacgctccgctcggcaagactttgtaaccttccgagcctttggtaagtgat

SEQ ID NO: 17359 - RNA, 162 nt, unidentified
  source 1..162: mol_type = other RNA; note = Related to SGNZ01000005.1; note = Agrobacterium salinitolerans
gcacttacgcgaatggcaacatagcttggtcgggcgcttcgctagacctaactcaattggcgtcctttttgcggctcggaaggttctaaagccttaccgcctccgccagaggccgctccgctcggtaagactttagaaccttccgagcctttggtaagtgat

SEQ ID NO: 17360 - RNA, 162 nt, unidentified
  source 1..162: mol_type = other RNA; note = Related to NZ_FMAG01000002.1; note = Rhizobium multihospitium
acacttacgcgaatggcaatgtagcttggtcgggcgcttcgctagacctcactcaattggtgtcctttttgcggctcggaaggttccaaagccttaccgcctccgccagaggccgctccgctcggtaagactttggaaccttccgagcctttggtaagtgat

SEQ ID NO: 17361 - RNA, 162 nt, unidentified
  source 1..162: mol_type = other RNA; note = Related to JACVBP010000001.1; note = Ensifer sp.
ttacttacgcgatgggcactactgctcggtcgggcgcttcgctagacctcaatcgattgaccgcttttattcggctcggaaggatatgcgatccatccgtccgataaatcggtcgctccgctcggatagctcacatttccttccgagccttaggtaagtgat

SEQ ID NO: 17362 - RNA, 160 nt, unidentified
  source 1..160: mol_type = other RNA; note = Related to JACGXN010000001.1; note = Phyllobacterium myrsinacearum
tcacttacgcgaatggcatgaattgcttggtcgggcgcttcgctagacctcatttgattgaccgggattattcggctcagaagggtgtgaatccttttcgccttcttcggtcgctccgctctacaaggcttcacacccttctgagcctttggtaagtgat

SEQ ID NO: 17363 - RNA, 160 nt, unidentified
  source 1..160: mol_type = other RNA; note = Related to NZ_CP043489.1; note = Labrys sp.
tcacttacgcgattagctttagagcttggtctggtgtttcgctagacctcaatcgattgggcagttttattgggctcggaaggttcaaaagccttgcagacccaatggggccgctccgctcagcaaggcttttgaaccttccgagccattggtaagtgat

SEQ ID NO: 17364 - RNA, 170 nt, unidentified
  source 1..170: mol_type = other RNA; note = Related to NZ_CP073063.1; note = Brevundimonas diminuta
ccacttacgcgtatgggttgaaattctgtttcgactttaagtctggcgcttcgccggacatcagttgattggtcattttttgggtgccgtgcaagagaccgacatcttgtcgcctttggacgctccgctctttcagatgccgttctcttgcacggccttaggtaagtgat

SEQ ID NO: 17365 - RNA, 155 nt, unidentified
  source 1..155: mol_type = other RNA; note = Related to JAHCDM010000009.1; note = Roseococcus sp.
ttgattacgtgatggcactgcttgtgctttgtctggcgtttcgccagacatgactggattgtacacttctggccggcgcgggaggccgcggcgactcgccgcgagccgctccgctcggcaagtcgccgcggcctcccgcgcctttggtaattgaa

SEQ ID NO: 17366 - RNA, 152 nt, unidentified
  source 1..152: mol_type = other RNA; note = Related to NZ_JXMU01000014.1; note = Ahrensia marina
gtacttacgcgaatggcctctggccttgtctggtgcttcgccagactttctaaaattggacttttcttgggcggctccaaggagcgaaggaacttatccttcacgctccgctgtctaagttccttcgctccttggagccttaggtaagtgca

SEQ ID NO: 17367 - RNA, 162 nt, unidentified
  source 1..162: mol_type = other RNA; note = Related to FOBJ01000004.1; note = Variovorax sp.
gttcttacgcgctctacggatgggtcacgtagaaacagtcgggcgattcgccagactttcaatgattgagtgcatttaccgcggtgaaaccggcttcgggatctcctgcgggcactcggagaacccgaagccggtttcaccgcgcaatttaaggtaagagct

SEQ ID NO: 17368 - RNA, 161 nt, unidentified
  source 1..161: mol_type = other RNA; note = Burkholderiales bacterium; note = Related to JAFKGB010000002.1
gttcttacgcgctctacgaatgggttacgtagaatagtcgggcgattcgccagacttttaatgattgagtgcatttaccgcggtgaaaccggcttcgggttttcctgcgagcactcggaaaacccgaagccggtttcaccgcgcaatttaaggtaagaact

SEQ ID NO: 17369 - RNA, 162 nt, unidentified
  source 1..162: mol_type = other RNA; note = Related to NZ_NRRT01000126.1; note = Rubrivivax gelatinosus
gttcttacgcgttctacggatgggtcacgtagagacagtcgggcgattcgccagacttgcaatgattgagtgcatttaccgcggtgaaaccggcttcgggttctcctgcgggcactcggagaacccgaagccggtttcaccgcgcaatttaaggtaagaacc

SEQ ID NO: 17370 - RNA, 162 nt, unidentified
  source 1..162: mol_type = other RNA; note = Related to JAFLDL010000016.1; note = Candidatus Accumulibacter sp.
gttcttacgcgttctacggatgggtcacgtagagacagtcgggcgcttcgccagacttgcaatgattgagtgcatttaccgcggtgaaaccggcttcgggttcgcctgcgggcactcggagaacccgaagccggtttcaccgcacaatttaaggtaggaact

SEQ ID NO: 17371 - RNA, 163 nt, unidentified
  source 1..163: mol_type = other RNA; note = Related to FP475956.1; note = Thiomonas arsenitoxydans
gtccttacgcgcttctacgtttcgggttacgtagaaaatgtcgggcgtttcgccagactcgtattgattgggtgcatttaccgctgcgaaaccggattcgggttttcctgcgggcactcggaaaacccgaatccggtttcgcagcgcatttctggtaaggact

SEQ ID NO: 17372 - RNA, 161 nt, unidentified
  source 1..161: mol_type = other RNA; note = Related to WWER01000012.1; note = Pusillimonas sp.
gttcttacgcgtctctacgtcaagggttacgtggatatgtcgggcgcttcgccagacttgcaatgattgagtgcatttaagctgcgaaagcggctccgcgttttcctgcgggcactcgaaaaacccgaagccgctttcgcagcatcttaaaggtaagaacg

SEQ ID NO: 17373 - RNA, 169 nt, Achromobacter sp.
  source 1..169: mol_type = other RNA; note = Related to CYTI01000014.1; note = Achromobacter xylosoxidans
tgctttacgtgtttctacggttttgggttccgtaggatagtcgggcgcttcgccagacagtcaatgattgaccgggattaccgccgcaaaggccgttcgggttttactgcggtccggtaggtcctcgaaaaacccgaacggcctttgcggcgcactttgggtaaagcaa

SEQ ID NO: 17374 - RNA, 160 nt, unidentified
  source 1..160: mol_type = other RNA; note = Related to NZ_JAJEJQ010000001.1; note = Paraburkholderia sp.
gcctttacgcggttctacgacgggctccgtagaatagtcgggcggttcgccagactgacaatgattgatcgagattaccgccgcgaaaccggtttcgggttttcctgcgggcactcggaaaacccgaaaccggtttcgcggcgcactttaggtagggcaa

SEQ ID NO: 17375 - RNA, 160 nt, unidentified
  source 1..160: mol_type = other RNA; note = Related to NZ_UWYX01000002.1; note = Burkholderia gladioli
cgctttacgcgattctacgacgggctccgtagaatagtcgggcggttcgccagactgacaatgattgaccgagattaccgccgcgaagccgctttcgggttctcctgcgggcactcggaaaacccgaaagcggcttcgcggcgcactttaggtaaggcaa

SEQ ID NO: 17376 - RNA, 160 nt, unidentified
  source 1..160: mol_type = other RNA; note = Related to QTRZ01000002.1; note = Burkholderia cenocepacia
cgctttacgcggttctacgacgggctccgtagaatagtcgggcgaactgccagactgacaatgattgaccgagattaccgccgcgaacccgctttcgggttctcctgcgggccctcggaaaacccgaaagcgggttcgcggcgcactttaggtaaggcaa

SEQ ID NO: 17377 - RNA, 170 nt, unidentified
  source 1..170: mol_type = other RNA; note = Related to NZ_JOMH01000001.1; note = Polycyclovorans algicola
ttttctacgcattgggctgggagcgtaggagaattgtcgggcgtttcgccagacttacatcgattgactgggattattgccgcaaactaccgtcgggattccctgcggtctcggtgcctcggtcctcggaaatcccgccggtagtttgcggcacagatcaggtaaagaga

SEQ ID NO: 17378 - RNA, 156 nt, unidentified
  source 1..156: mol_type = other RNA; note = Related to JACVAP010000002.1; note = Xanthomonas sp.
gctttttagcggtctgcgtttgccgcgcagatagtctgacgcttcgtcggactgttgaaattgcgtgggattatcgccgtaaagccggtgcccggcttcgctgcgagccctcgcaaagccgggcaccggctttacggcgcatcaaagtaaaaagca

SEQ ID NO: 17379 - RNA, 171 nt, unidentified
  source 1..171: mol_type = other RNA; note = Related to PBYA01000036.1; note = Salinisphaera sp.
ctctttacgcgattccatgcgttgggtttgtggaatagtcgggcgattcgccagacagttatttattgaccgggtttatcaccgcgaaaacgcaggcgggtttccctgcgcttccggtaggttctcggaaaacccgcctgcgttttcgcggtgcaatttgaggtaaagggt

SEQ ID NO: 17380 - RNA, 170 nt, unidentified
  source 1..170: mol_type = other RNA; note = Related to JAIOAJ010000071.1; note = Stenotrophomonas maltophilia
ctcttcacgcgatgcgacatggagtcgacatggtctggcgttgcgccagacagctagggattgattgggtttatcgccccgcatagccggtacggtctcaccgttccggtccagtgggtcctcgcggtaagcccgtaccggctatacggggcgttttcttggtgaagaga

SEQ ID NO: 17381 - RNA, 170 nt, unidentified
  source 1..170: mol_type = other RNA; note = Related to JADUKR010000001.1; note = Stenotrophomonas maltophilia
ctctttacgcgatgtgacaggaagtcgatgtggtctggcgttgcgccagacagcaatgaattgaacgggattatcgccccgcacagccggcacggtctcaccgctccggtccagcgggtcctcgcggtaagcccgtgccggctgtgcggggcgttctcttggtgaagagc

SEQ ID NO: 17382 - RNA, 175 nt, unidentified
  source 1..175: mol_type = other RNA; note = Related to MIGM01000010.1; note = Xanthomonas arboricola
ctctttacgcgacgtgacatggaaagttaatggttaagtctggcgttgcgccagactgcaaagaattgattgggtttatcgccccgcatagccggctcggtctcaccgctccggtccagtgggtcctcacggtaagcccaatccggctatgcggggcgttctcttggtgaagagc

SEQ ID NO: 17383 - RNA, 185 nt, unidentified
  source 1..185: mol_type = other RNA; note = Related to NZ_JQNL01000001.1; note = Luteibacter sp.
ctctttacgcgaatggcaaggggaaatgccgaagctgttgactgtgtctggcgatgcgccggactgctaaggattgattgggattaccgccccgtgtagccggcttggtctcaccacctccggtccagtgggtcctcaatggtaagcccaagccggctacacggggcgtcttcatggtaaagagt

SEQ ID NO: 17384 - RNA, 180 nt, unidentified
  source 1..180: mol_type = other RNA; note = Related to NZ_CP093547.1; note = Lysobacter gummosus
ctctttacgcgacggcaatggaatgccacgaattgtgaaatgtccggcgctgcgccggacggcgagggattgattgggattatcgccccgtataaccggctcgggctcaccgcctccggtccgcgggtcctcggcggtaagcccgatccggttatacggggcggtttcttggtgaagaga

SEQ ID NO: 17385 - RNA, 176 nt, unidentified
  source 1..176: mol_type = other RNA; note = Related to JACVAK010000003.1; note = Pseudoxanthomonas sp.
ctcttcacgcgattggcgatggaacgccgctgcgaaaggactgggtccggcgttgcgccggacgggtatggattgttgactcttatcgccccgtacagccggctaggcctcaccgccacctgctcggtggtggtaaggcctagccggctgtacggggcggtttcttggtgaagagt

SEQ ID NO: 17386 - RNA, 184 nt, unidentified
  source 1..184: mol_type = other RNA; note = Related to JACVAG010000005.1; note = Pseudoxanthomonas sp.
ctctttacgcgttaggcaagggaactgccagcactatgcgggaatggtccggcgttgcgccggacagcaaagaattgtctgggtttatcgccccgtacagccggattggtctcaccgctccggcccttcgtacctccgcggtaagcccaatccggctgtacggggcgtttttggggtaaagagt

SEQ ID NO: 17387 - RNA, 165 nt, unidentified
  source 1..165: mol_type = other RNA; note = Related to NZ_FUXP01000009.1; note = Lysobacter spongiicola
ctctttacgcgtgcgatcagggctgatcgttatgtcgggcgattcgccagactggatgaggattgtcttcacttatcggcggaaaacaccgcggggcctcacctcctccgcgttgctcccccggtaagtccccgcggcgttttccgcctatttagggtaaagagc

SEQ ID NO: 17388 - RNA, 165 nt, unidentified
  source 1..165: mol_type = other RNA; note = Related to NZ_CP041965.1; note = Xanthomonas arboricola
ctctttacgcgtgcgatcaaggtagatcgatatgtcgggcgtttcgccagactgtataaggattggtagcacttatcggcggaaagcaccgcggggtctcacctcctccgcttcgctcccccggtaagcccccgcggcgttttccgcctatctagggtaaagagt

SEQ ID NO: 17389 - RNA, 166 nt, unidentified
  source 1..166: mol_type = other RNA; note = Related to VCME01000014.1; note = Xanthomonas hortorum
ctctttacgcgtttgatcatggctgatctgcttgtcgggcgtttcgccagactgtataaggattgttgacttttatcggcggaaaacaccgcgaggccttacctcctccgcgtgcgctcccccggtaaggcctcgcggcgttttccgcctttttaaggtaaagaga

SEQ ID NO: 17390 - RNA, 166 nt, unidentified
  source 1..166: mol_type = other RNA; note = Related to JAAAEX010000007.1; note = Stenotrophomonas maltophilia
ctctttacgcgcttggtcaaggtagatcgaattgtcgggcgtttcgccagactgtataaggattgtcggtatttatcggcggaaaacaccgcggggcctcacctcccccgcatgcgctcccccggtaagtccccgcggcgttttccgcctatttaaggtaaagagt

SEQ ID NO: 17391 - RNA, 164 nt, unidentified
  source 1..164: mol_type = other RNA; note = Related to NTJG01000001.1; note = Xanthomonadaceae bacterium NML93-0793
ctctttacgcgaatgatcaggattgatcaaattagtcgggcgcttcgccagacagtttaaggattgacggtatttatcggcggaaaacaccgcggggcctcacctccgcagaagctcctccggtaagtccccgcggcattttccgcctttaaaaggtaaagggt

SEQ ID NO: 17392 - RNA, 181 nt, Nitrosomonas sp.
  source 1..181: mol_type = other RNA; note = Related to FODO01000031.1
ctctttacgcgttcggggctttaaaaaaatctcatatggttttatagccttagtccggcgcttcgccagacttttattattggtagtatttgtaggcacaaaatccgtgatcgatcagactgcgcgtaaaacagcttgctgatcgctcccaaattttgtgcctatttttagggtaaagaga

SEQ ID NO: 17393 - RNA, 152 nt, unidentified
  source 1..152: mol_type = other RNA; note = Related to NZ_BMMF01000004.1; note = Salinarimonas ramus
ctctttacgcgaacggggggctacccccctgccgggcgtttcgccaggcaatcgaaaattgatcgagtttaacggcgcggacgacgggcttaactgcaccgaagtctcggcgcagttaagcccgtcgtccgcgccttctttaggtaaagagc

SEQ ID NO: 17394 - RNA, 177 nt, unidentified
  source 1..177: mol_type = other RNA; note = Related to NZ_RXOL01000001.1; note = Croceicoccus ponticola
ctctttacgcgtaagttggagttccatccccaacttcgtcgggcgcttagccagacgtttatgttattgggagcgtttatcggcaggaaaggcctggagagctcatctcttcggcaagcctcgcccttcgggccgatgacctctccaggcctttcctgccttcctgaggtaaagaga

SEQ ID NO: 17395 - RNA, 193 nt, unidentified
  source 1..193: mol_type = other RNA; note = Related to NZ_CP069354.1; note = Microvirga sp.
ctctttacgcgtttcgagtcgatcaaggtttccccttgtgaaactcggtcgggcgcttcgccagacagaccgttattgggtaggtttatcggcatgaaggaggctggagagttcatctctcgtcgcctttagctcctcgcccttcggtacgatgacctctccagcctccttcataccttcaaaggtaaagagt

SEQ ID NO: 17396 - RNA, 188 nt, unidentified
  source 1..188: mol_type = other RNA; note = Related to QRGO01000001.1; note = Undibacter mobilis
ctctttacgcgtttcgaatctgtttgggtaaccaagcgggttctcgtcgggcgcttagccagacataacgttattgtggaggtttatcgggatggtgagggtcggagagcttatctctcgtcgctctcgctcctcgcctgcggccgataagctctccgaccctcaccatcccttcaacggtaaagagc

SEQ ID NO: 17397 - RNA, 190 nt, unidentified
  source 1..190: mol_type = other RNA; note = Related to SALN01000219.1; note = Mesorhizobium sp.
ctctttacgcgaaaggagtcggtcgcaactgtatcgatcttctcttgtcgggcgcttagccagacatcacgttattgtgggcgtttatcggtatgaacaagcccgaggaggccatctctcgtcgccttcgctcctcgcctgcggccgatgccctcctcgaactagttcatacctctcaaaggtaaagagt

SEQ ID NO: 17398 - RNA, 188 nt, unidentified
  source 1..188: mol_type = other RNA; note = Related to NZ_CP011479.1; note = Hoeflea sp.
ctctttacgcgtatgagagtggttcagaaattctgttccttctcttgtcgggcgcttagccagacattctgttattgtgagcgtttatcggcatgagcatggccaagaaggccatctctcgtcgcttcgctcctcgtctacgagcgatgtccttcttggccatgctcatacctttaagggtaaagagc

SEQ ID NO: 17399 - RNA, 186 nt, unidentified
  source 1..186: mol_type = other RNA; note = Related to JAHBYX010000006.1; note = Mesorhizobium sp.
ctctttacgcgaatggagtcggtcctcgtttggatcagctcttgtcgggcgtttcgccagacattctgttactgtgggcgtttgtcggtatgaacggggttgagaaggccatctctcgtcgcctatgctcctccccttcgggccgatgcccttctcaaccccgttcataccttctaggtaaagagt

SEQ ID NO: 17400 - RNA, 176 nt, unidentified
  source 1..176: mol_type = other RNA; note = Related to RXIO01000070.1; note = Ancylobacter aquaticus
ctttttacgcgctaggggagcgcaagctccccgagtcgggcgattcgccagacaaattaagattgctgaggtttatcggcagggaagtcttcggagaggtcggctctcgtcgccagctcctcgcctcccggccgccgacctctccaaagccttccctaccgtcaaaggtaaagagc

SEQ ID NO: 17401 - RNA, 177 nt, unidentified
  source 1..177: mol_type = other RNA; note = Related to CP090554.1; note = Neorhizobium galegae
ctctttacgcgttttgagccatcactttggtgatggttccgtcgggcgctaagccagacggtaatgacattgtgagcgtttatcggcaggaagaagctcgagagtccacctctcggcttacgcctcgttaccaccggtgaactctcgatcttcttcccgccttcagaggtaaagagt

SEQ ID NO: 17402 - RNA, 179 nt, unidentified
  source 1..179: mol_type = other RNA; note = Related to NZ_PCDP01000036.1; note = Rhizobium tubonense
ctctttacgcgttttgagtcgtcaactgagttgatcggctacgtcgggcggtaagccagacggaattaaaactgtgagcgtttatcggcaggaagaagaccgagagttcacctctcggcttacgcctcgttccaccggtgaactctcggtcttcttcctaccttccagaggtaaagagt

SEQ ID NO: 17403 - RNA, 169 nt, unidentified
  source 1..169: mol_type = other RNA; note = Related to NZ_FPAJ01000001.1; note = Sulfitobacter marinus
ctctttacgcgtttgaacctgcgtggttccgtcgggcgtttagccagacgacatgttattggggggtcttatcggcaggtagatcgtggactagccatctctcggctatcgcctcgcctacggtcgatggctactccacgatctacctgcctctttaagggtaaagaga

SEQ ID NO: 17404 - RNA, 169 nt, unidentified
  source 1..169: mol_type = other RNA; note = Related to NZ_SDEA01000022.1; note = Paracoccus luteus
ctctttacgcggatgaaccttcgtggttccgtcgggcgcttagccagacgaattgttattgggtggtcttatcggcaggaagctcgtggagcagccatctctcggcttgcgcctcgcctgacggccgatggctgctccacgagcttcctgcctcctaagggtaaagagc

SEQ ID NO: 17405 - RNA, 177 nt, unidentified
  source 1..177: mol_type = other RNA; note = Related to NZ_LMEM01000009.1; note = Devosia sp.
ctctttacgcgttttgaaccaggcgtgcttggttccgtcgggcgcttagccagacgtcccgttattgataggtcttatcggcaggactagacgcgagaactcatctctcggctacgcctcgcaccttcggcaccgatgagtcctcccgtctactcctgcctctctgaggtaaagagc

SEQ ID NO: 17406 - RNA, 171 nt, unidentified
  source 1..171: mol_type = other RNA; note = Sphingomonadales bacterium; note = Related to JAFKLT010000057.1
agcttcacgcgaatgggccttgcgccctgtcgggcggttcgccagacatgcatggattgaacgatattggcggctcggttcggccttgggttcccttggccctacggggcgttctcttcgttcactccaaggaaacccaaggccgaaccgagcctttcaaaggtgaagctt

SEQ ID NO: 17407 - RNA, 149 nt, unidentified
  source 1..149: mol_type = other RNA; note = Related to AWFC01000023.1; note = Hyphomonas sp.
gttcttacgcgtaatcaccggtttgtcgggcgtttcgctagactgaaatgtgattggttctatctagggcgcgcttagagtcgcgaattctaagccgacacggtcgccttagaattcgcgactctaagcgtcgctcaaaggtaagaaat

SEQ ID NO: 17408 - RNA, 186 nt, unidentified
  source 1..186: mol_type = other RNA; note = Related to DOSK01000382.1; note = Brevundimonas sp.
ctctttacgcgtaggtcgattccccgtgaaccgatctgtgtcgggcgcttcgccagaccatacgttattgtgaggtttaatcggtagggatgggtcccgagggctcatctcttcgtcgcggaaggctcctcggccttcggcccgatgacccctcgcgacccatccctaccttcacaggtaaagaga

SEQ ID NO: 17409 - RNA, 186 nt, unidentified
  source 1..186: mol_type = other RNA; note = Related to FOOA01000003.1; note = Aureimonas phyllosphaerae
ctctttacgcgtctaaggtgtcctggaatcaggagccctgtcgggcgatcagccagacagaatggtattgtggaggtttatcggtatgaagaagaccgggagtttatctctcgtcaccttcgttcctcgtcgccttgcgagcgataaactcccggtcttcttcataccttttctgaggtgaagggc

SEQ ID NO: 17410 - RNA, 138 nt, Vibrio sp.
  source 1..138: mol_type = other RNA; note = Related to CP023054.1; note = Vibrio anguillarum
atctttacgcgttagaagcgttgttgacttcatctggtgtatcactggaatattttgattgtttatattttgaccacggtcacgacaaaaatcgcttcgcgatttgttgtcgcaaccgtgcccatctaggtaaagatt

SEQ ID NO: 17411 - RNA, 137 nt, unidentified
  source 1..137: mol_type = other RNA; note = Related to CH724143.1; note = Photobacterium sp.
atctttacgcgttagaagcgttgctgacttcatctggtgtatcactagaatattttattgtttatattttgatcacggtcacgacaaaaatcgcttcgcgatttgttgccgcaaccgtgcccatctaggtaaagatt

SEQ ID NO: 17412 - RNA, 137 nt, Vibrio sp.
  source 1..137: mol_type = other RNA; note = Related to JAKKCQ010000002.1
atctttacgcgtaagaagcgttgacgacttcatctggtgtatcactagaattattgattgtttataatttgaccacggtcacgtcaaaaatcgcttcgcgatttgttgccgcaaccgtgtccatctaggtaaagatt

SEQ ID NO: 17413 - RNA, 137 nt, Proteus sp.
  source 1..137: mol_type = other RNA; note = Related to JADRZV010000010.1; note = Proteus mirabilis
atctttacgcgttagaagcgctactgacttcatctggtgtatcactagaatatttgattgtttatattttgaccacggtcacgtcaaaaatcccttcgtgatttgttgccgcaaccgtggccatctaggtaaagatt

SEQ ID NO: 17414 - RNA, 137 nt, unidentified
  source 1..137: mol_type = other RNA; note = Related to NZ_LTZD01000015.1; note = Aliivibrio fischeri
atctttacgcgaacgaagcgttgtcgacttcatctggtgtatcactagaatttttgattgtttatattttgaccacggtcacggcaaaaatcgcttcgcgatttattaccgcaaccgtgcccatctaggtaaagatt

SEQ ID NO: 17415 - RNA, 137 nt, unidentified
  source 1..137: mol_type = other RNA; note = Related to PYNJ01000059.1; note = Photobacterium kishitanii
atctttacgcgaagaagcgttacagacttcatctggtgtatcaccggaatttaacgattgttatccttttgatcacggtcactccaaaaatcgcttcgcgatttgttgtcgcaaccgtgaccatctaggtaaagata

SEQ ID NO: 17416 - RNA, 134 nt, unidentified
  source 1..134: mol_type = other RNA; note = Related to CP045427.1; note = Shewanella sp.
atctttacgcgttagaagtatatcttcatccggcgtatcgccggagcttagtaattgggtaaaattacgagcacgatactcgaaaaatcgctacgcgatttgttctcgcatcgtgcccgatctaggtaaagata

SEQ ID NO: 17417 - RNA, 135 nt, Vibrio sp.
  source 1..135: mol_type = other RNA; note = Related to NZ_CP042449.1; note = Vibrio alginolyticus
gtctttacgcgttagaagtataatcttcatctggcgtatcgccggagctttgtaattgggtaaaattacgagcacgatactcgaaaaatcgcttcgcgatttgttctcgcatcgtgcccgatctaggtaaagata

SEQ ID NO: 17418 - RNA, 132 nt, Salmonella sp.
  source 1..132: mol_type = other RNA; note = Related to AAIODZ010000022.1; note = Salmonella enterica
ctctttacgcgatagaggcgtacttgcttcatccggtgtatcactggaatttttcgattgtggtcatttatgccacggccttcccaaaaatcttcgatttttactcaggccgtgcccttctaggtaaagagc

SEQ ID NO: 17419 - RNA, 132 nt, unidentified
  source 1..132: mol_type = other RNA; note = Related to NZ_CP025085.1; note = Serratia sp.
ctctttacgcgatagaggcgtatctgcttcatctggtgtatcaccggaacttgttgattgtggtcatttatgccacggccttcccaaaaatcttcgatttttactcaggccgtgcccttctaggtaaagagc

SEQ ID NO: 17420 - RNA, 134 nt, unidentified
  source 1..134: mol_type = other RNA; note = Related to DAEHES010000012.1; note = Serratia fonticola
ctctttacgcgtttgaagcgtatacagcttcatccggtgtatcaccggaacttttggattgtggctatttgggccacggtctgagtgaaaatctcacgattttaactcagcccgtgcctttcttggtaaagagc

SEQ ID NO: 17421 - RNA, 133 nt, unidentified
  source 1..133: mol_type = other RNA; note = Related to JAFJZU010000009.1; note = Pectobacterium brasiliense
ctctttacgtgtttgaagcgtatacagcttcatctggtgtatcaccagaacttttagattgtggccacttatgacacggtcaccgtaaaaatcgcagatttttacgccgcccgtgcctttcttggtaaagagt

SEQ ID NO: 17422 - RNA, 159 nt, unidentified
  source 1..159: mol_type = other RNA; note = Related to NZ_CP009769.1; note = Pectobacterium brasiliense
actctttagcgttaggctttgatttatagccttgtcgagcgttccgccagacactaacttattgagtacttttagggttgcgctagaaagttttctaccgatcctagaagtctctaggatcggtagaaaactttctagcgcctcctctagtaaagagta

SEQ ID NO: 17423 - RNA, 140 nt, unidentified
  source 1..140: mol_type = other RNA; note = Related to NZ_CP034015.1; note = Shewanella livingstonensis
gtctttacgcgctagaagcgtgatctgcttcatctggtgtatcactagaagtgtttgattgttagtttttctgagcacggccaccacgaaaatcggcaagccgatttgtcgcggcgtccgtgccctttaaggtaaagata

SEQ ID NO: 17424 - RNA, 140 nt, unidentified
  source 1..140: mol_type = other RNA; note = Related to JAHKRD010000001.1; note = Shewanella sp.
aactttacgcgctagaagcgtgacttgcttcatccggtgaatcgctggaactattagattgttgttttttctgagcacggccaccacgaaaatcgcttcgcgatttatcgcggcgtccgtgcccttttaaggtaaagtgt

SEQ ID NO: 17425 - RNA, 141 nt, Aeromonas sp.
  source 1..141: mol_type = other RNA; note = Related to NZ_CDBP01000069.1; note = Aeromonas dhakensis
aactttacgcgtgtgaagcatgcgagcggcttcatctggtgtatcaccggagctttatgattgtgctcatttatgagcacggccaccgcgaaaatcgcttcgcgatttatcgcggcgtccgtgccctttaaggtaaagtat

SEQ ID NO: 17426 - RNA, 139 nt, Vibrio sp.
  source 1..139: mol_type = other RNA; note = Related to CP001805.1
tactttacgcgcttgaagcgtgacctgcttcatctggtgtatcaccggagctttaaattgtgtttttttatgagcacggtcaccacgaaaatcggcaagccgatttgtcgtggcgtccgtgccctttaaggtaaagtta

SEQ ID NO: 17427 - RNA, 139 nt, Vibrio parahaemolyticus
  source 1..139: mol_type = other RNA; note = Related to CP006004.1
tactttacgcgctagaagcgtgaccagcttcatctggtgtatcaccggagctttgtattgtggttttttatgagcacggtcaccacgaaaatcggcgggccgatttgtcgtggcgcccgtgccctttaaggtaaagtac

SEQ ID NO: 17428 - RNA, 135 nt, unidentified
  source 1..135: mol_type = other RNA; note = Related to NZ_SRZX01000002.1; note = Marinobacter orientalis
tgtcttacgcgttaagcaatgacagcttaggtctggcgctccgctagatttcacgattgacggtcatgaagtcacgtgatcacgaaacccctaaaacgggctttcgcgctcacgtgcctttctaggtaagcacaa

SEQ ID NO: 17429 - RNA, 142 nt, unidentified
  source 1..142: mol_type = other RNA; note = Related to DACSHB010000002.1; note = Legionella pneumophila
tgttttatgcggatttattggttttgctcggcgtttcgctgagctataaattggattggttaaatttataagcgagttattggataaatttaatcaattttgattaaatttatccaataactcgatttcaaagataaaacac

SEQ ID NO: 17430 - RNA, 142 nt, unidentified
  source 1..142: mol_type = other RNA; note = Related to DACVYU010000020.1; note = Legionella pneumophila
tgttttatgcggatttattggttttgctcggcgtttcgcagagctataaataggattggttaaatttataaacgagttattggataaatttaatcaaaattgattaaatttatccaataactcggtttcaaagataaaacat

SEQ ID NO: 17431 - RNA, 168 nt, Pseudomonas sp.
  source 1..168: mol_type = other RNA; note = Related to JACYWS010000002.1; note = Pseudomonas syringae
ctctttacgcgtttaaagccagacgctagtcgtcgagggcttagtcaggcgtttcgccagactcaatcgcattgcgttgttttattccgcagacaagatctgcggccctacgctccttcgtcgctccggtccacagatcttgtctgcggctgttccttggtaaagagt

SEQ ID NO: 17432 - RNA, 168 nt, Pseudomonas sp.
  source 1..168: mol_type = other RNA; note = Related to NZ_JACOPX010000017.1; note = Pseudomonas neuropathica
ctctttacgcgtttaaagccagatactagtcgttgaaggcttagtcaggcgtttcgccagactcaattgcattgcgttgttttattccgcagacaagatctgcggccctacgctccttcgtcgctccggtccacagatcttgtctgcggctgaaccttggtaaagagc

SEQ ID NO: 17433 - RNA, 169 nt, Pseudomonas sp.
  source 1..169: mol_type = other RNA; note = Related to CP089062.2; note = Pseudomonas aeruginosa
ctctttacgcgtttaaagctagatgctagtcgctgaaggcttagtcaggcggttcgccagactcaactgtattgcgttgttttattccgcagacaagatctgcggccctacgactccttcgtcgctccggtccgcagatcttgtctgcggctgtaccttggtaaagagc

SEQ ID NO: 17434 - RNA, 169 nt, Pseudomonas sp.
  source 1..169: mol_type = other RNA; note = Related to NZ_CP077094.1; note = Pseudomonas promysalinigenes
ctctttacgagtttaaagctagcagctatttgctgaaggcttagtcaggcgcttcgccagactcaatagcattgcgttgttttattccgcagacaagatctgcggccttacgactccttcgtcgctccagtccgcagatcttgtctgcggctgtaccttggtaaagagc

SEQ ID NO: 17435 - RNA, 172 nt, Pseudomonas sp.
  source 1..172: mol_type = other RNA; note = Related to JACGDE010000010.1; note = Pseudomonas mosselii
ctctttacgcgtttaaagcttgaagctagtcgctgaaagcttagtcaggcggttcgccagactcaattgcattgcgttgttttattccgcagacaagatctgtggccctacgctcgctactcgctcactccggtccacagatcttgtctgcggctgttccttggtaaagagc

SEQ ID NO: 17436 - RNA, 170 nt, Pseudomonas sp.
  source 1..170: mol_type = other RNA; note = Related to NZ_CP035088.1; note = Pseudomonas viciae
ctctttacgcgtttatagctagacggtttccgtcaatggcttagtcaggcggttcgccagactcaattgcattgcgttgttttattccgcagacaagatctgcggccctacgctcgcttcgctcactccggtccacagatcttgtctgcggctgattcttggtaaagagc

SEQ ID NO: 17437 - RNA, 169 nt, Pseudomonas sp.
  source 1..169: mol_type = other RNA; note = Related to NZ_CP014205.2; note = Pseudomonas glycinae
ctctttacgcgttcatagcttgatggtttccatcattgcttagtcaggcgcttcgccagactcaattacattgcgttgttttattccgcagacaagatctgcggccctacgctcgcttcgctcactccggtccacagatcttgtctgcggctgattcttggtaaagagc

SEQ ID NO: 17438 - RNA, 169 nt, Pseudomonas sp.
  source 1..169: mol_type = other RNA; note = Related to NZ_CP031641.1; note = Pseudomonas parafulva
ctctttacgcgtttaaagctcgaagctagtcgctgaaggcttagtcaggcgattcgccagactcaattgcattgctttgttttattccgcagacaaggtctgcggccctacgactcctccgtcgctccggtccgcagaccttgtctgcggctgtaccttggtaaagagc

SEQ ID NO: 17439 - RNA, 173 nt, Pseudomonas sp.
  source 1..173: mol_type = other RNA; note = Related to NZ_CP019428.1
ttctttacgcgttcaaagcttgatagcagacgctgtcttaaggcttagtcgggcgtttcgccagactcaaaatcattgcttggttttattccgcagacaagatctgcggacctacactcgcaagctccctccggtccgcagatcttgtctgcggctgattcttggtaaagagc

SEQ ID NO: 17440 - RNA, 174 nt, Pseudomonas fluorescens
  source 1..174: mol_type = other RNA; note = Related to NZ_CABVJA010000003.1
ttctttacgcgttcaaagctagtcagcatatgctgtctgaaggcttagtcgggcgtttcgccagactcaaatttattgcttggctttattccgcagacaagatctgcggacactacggtcgcaagctccctccggtccgcagatcttgtctgcggctgattcttggtaaagagc

SEQ ID NO: 17441 - RNA, 171 nt, Pseudomonas sp.
  source 1..171: mol_type = other RNA; note = Related to NZ_JAAQXL010000002.1; note = Pseudomonas proteolytica
ctctttacgcgaacaaagtcgaaagaccgttttgtctgaggcttagtcgggcgtttcgccagactcatatgcattgcttggatttattccgcagagaaaatccgcggacctacagtcgcaagctccctccagtccgcgaattttctctgcggctgattcttggtaaagagt

SEQ ID NO: 17442 - RNA, 171 nt, Pseudomonas sp.
  source 1..171: mol_type = other RNA; note = Related to BPLZ01000028.1
ttctttacgcgaatagagccaagggtctcaacaatccacaggcttagtcgggcgcttagccagactcaataatattgcttcgttttgttccgcagagaagttctgcggacctacacatgaagcgcgttccggtccgcagaacttctctgcggctgttccttggtaaagagc

SEQ ID NO: 17443 - RNA, 170 nt, Pseudomonas sp.
  source 1..170: mol_type = other RNA; note = Related to CP041771.1; note = Pseudomonas aeruginosa
ttctttacgcgttttgggcttcaagttctagggcttaagctcagtcgggcgcttagccagactcaattgattgtgcagttttattccgcagataagctctgcggccctccggtcgcattcgctccctgcggtccgcagatcttatctgcggctggtccttggtaaagaac

SEQ ID NO: 17444 - RNA, 162 nt, unidentified
  source 1..162: mol_type = other RNA; note = Related to LASC01000001.1; note = Burkholderia contaminans
ttctttacgcgaatatagctagaacgatttgcttagcttagtcgggcgtttagccagactcattttcattgcttggttttattccgcagctaacggctgcggccctccaggcgctgccttacggtccacagccgttatctgcggccggttcaggtaaagaac

SEQ ID NO: 17445 - RNA, 162 nt, unidentified
  source 1..162: mol_type = other RNA; note = Related to NZ_CADEWJ010000002.1; note = Burkholderia gladioli
ttctttacgcgaatatagctaggacgatttgtatagcttagtcgggcgtttagccagactcaattttattgcttggttttattccgcagctaacggctgcggccctccaggcggagccttacggtccgcagccgttagctgcggccggttcaggtaaagaac

SEQ ID NO: 17446 - RNA, 169 nt, unidentified
  source 1..169: mol_type = other RNA; note = Related to NZ_CP017757.2; note = Cupriavidus necator
ttctttacgcgaatagagcctgtgtcgaaattgaatacagcttagtcgggtgtttagccagactccatttgattgcttggacttattccgcagataaggtctgcggtcctccagtcgcaagcgccctccggcccgcagcccttatctgcggacgttctaggtaaagaac

SEQ ID NO: 17447 - RNA, 179 nt, unidentified
  source 1..179: mol_type = other RNA; note = Related to QFXG01000005.1; note = Candidatus Nitrotoga sp. SPKER
ttctttacgtgaataaagcttattaaggttgtttgcttaataacttagtcgggtgtttagccagactctatataaattgtgtggatttaggccgcagataatttctgcggctctccgttcgcaaaatcagctctctacgatccacagaaattatctgcggcacgttctaggtaaagaac

SEQ ID NO: 17448 - RNA, 173 nt, unidentified
  source 1..173: mol_type = other RNA; note = Related to JABFOH010000005.1; note = Acidithiobacillus ferrooxidans
ttctttacgtgaataaagcttattaaggttgttaacttaatggcttagtcgggcgtttagccagactctattatattgtatggacttaggccgcagatagtttccgcggttctccgttcgcaagctctctacgatccgcggaaactatctgcggcacgttctaggtgaagaac

SEQ ID NO: 17449 - RNA, 170 nt, unidentified
  source 1..170: mol_type = other RNA; note = Related to NZ_RJUK01000001.1; note = Marinimicrobium koreense
tcttccacgagaacagagctttatactttataaaagcttagtcgggtgtttagccagactctacttgcattgcgtggttttattccgcagataacatctgcggatctccaatcgcgccagcgctcattacgatccacagatgttatctgcggagatcagaggtgggagaa

SEQ ID NO: 17450 - RNA, 146 nt, unidentified
  source 1..146: mol_type = other RNA; note = Related to MVDH01000001.1; note = Cellvibrio sp.
gcttttacgtgaataaagcctatggcttagtcgggtgtttagccagactctattttattgggtggttttattccgcagataacatctgcgtatctccacttcgttacgatccacagatgttatctgcggacgcttaggtaaaagct

SEQ ID NO: 17451 - RNA, 167 nt, Pseudomonas sp.
  source 1..167: mol_type = other RNA; note = Related to NZ_BQIK01000019.1
ctctttacgcgtttgctttatgctttttagctaaagctagtcgggcgtttcgccagactctactgagattggttagatttattccgcagagaatttccgcggacctccagtcgcaagctccgttccgatccgcgaaaattctctgcggccggatcttggtaaaggca

SEQ ID NO: 17452 - RNA, 166 nt, Pseudomonas sp.
  source 1..166: mol_type = other RNA; note = Related to JAFFZW010000005.1; note = Pseudomonas alliivorans
ttctttacgcgtacaagctcggtctcggtaccgatgcttagtcgggcgattagccagactctagaaaattgcttggatttattccgcagagaatatctgcggccctccaatcgcgggctcattacggtccacagatattctctgcggctgtttcttggtaaagaac

SEQ ID NO: 17453 - RNA, 165 nt, Pseudomonas sp.
  source 1..165: mol_type = other RNA; note = Related to MSXW01000061.1
ttctttacgcgtaaaagctaggctgcacagccagagcttagtcaggcgcttcgccagactctatgaaattgtttggttttattccgcagacgaaatctgcggccctccaatcgcaagctcattacggtccacagattccgtctgcggctgtccttggtaaagaat

SEQ ID NO: 17454 - RNA, 163 nt, Pseudomonas sp.
  source 1..163: mol_type = other RNA; note = Related to POUU01000009.1; note = Pseudomonas stutzeri
ttctttacgcgtatagctaggctgtaagccagagcttagtcgggcgcttagccagactctatgaaattgtttggatttattccgcagagaatctctgcggccctccactcgcaagctccctacggtccacagagattctctgcggccgttcttggtaaagaaa

SEQ ID NO: 17455 - RNA, 176 nt, unidentified
  source 1..176: mol_type = other RNA; note = Alphaproteobacteria bacterium; note = Related to SDYH01000002.1
gtctttacgcgaacagagcgtttacacgttacaacgttgcaaaagcttagtcgggcgtttagccagactcatatttattgcttggtcttaagccgcagagcttctccgcggtcctacattcgacaagctctctccggcccgcggagaatctctgcggctgatttcaggtgaagaca

SEQ ID NO: 17456 - RNA, 170 nt, unidentified
  source 1..170: mol_type = other RNA; note = Related to JACVPK010000010.1; note = Polynucleobacter wuianus
ttctttacgatgatattgctttaatagtatttatattaggcatagtcgggcgtttagccagactctatttgattgtttggatttaatccgcagattcgctccggatgcctccaagcaaaaccagctttacggcctccagaccaaatctgcggctcgttcaggtaaagagc

SEQ ID NO: 17457 - RNA, 174 nt, unidentified
  source 1..174: mol_type = other RNA; note = Related to JACYMM010000001.1; note = Janthinobacterium sp.
ttctttacgcgaataaaattgccgacattcatcatcgtttgcaatttagtcgggcgattagccagactctattttattgcttggacttgagccgcagcgacaatttgcggccctacgttcggcgagctctctccagtccgcaaattgtcgctgcggctgttctaggtaaagaac

SEQ ID NO: 17458 - RNA, 168 nt, unidentified
  source 1..168: mol_type = other RNA; note = Related to NZ_CP033019.1; note = Janthinobacterium agaricidamnosum
ttcttcacgcgaatgtggttacgaaagtatccgtaacttagtcgggcggttagccagactctatatgattgtggcgacatgagccgcagcggcattttacggccctacgctcgctcacgctcgactccgatccgcaaaatgccgctgcggcttttctaggtgtagaac

SEQ ID NO: 17459 - RNA, 171 nt, unidentified
  source 1..171: mol_type = other RNA; note = Related to NZ_WNKY01000042.1; note = Duganella radicis
ttctttacgcgaataaagactcatctttcgagatgtagccttagtcgggcgattagccagactctatgggattgattggacttgagccgcagcgaaaatttgcggccctacaatcggctccgcctcattccggtccgcaaatttccgctgcggcttttctaggtgaagaat

SEQ ID NO: 17460 - RNA, 173 nt, unidentified
  source 1..173: mol_type = other RNA; note = Related to LRON01000007.1; note = Duganella sp.
ttctttacgcgaacaaagactcatctcattgagatgttggcttagtcgggcgattagccagactctattggattgatctcacttgagccgcagcgaaaatttgcggccctacaatcggcttgcgcctcattccggtccgcaaatttacgctgcggcttttctaggtgaagaat

SEQ ID NO: 17461 - RNA, 161 nt, unidentified
  source 1..161: mol_type = other RNA; note = Related to NZ_CP016442.1; note = Burkholderia stabilis
ttctttacgcgaacagagctaggcagcttttaggttttagcttagtcgggcgattagccagactccttttgattgggcggccctattccgcggataagctctgcggccctccgcccgctacggtccgcagagcttatccgcggccgttctaggtaaagaac

SEQ ID NO: 17462 - RNA, 168 nt, unidentified
  source 1..168: mol_type = other RNA; note = Related to NZ_CADEZN010000001.1; note = Burkholderia gladioli
ttctttacgcgaacacggctagacaccgttgtgccttagcttagtcgggcgattagccagactctttttgattggacggtcctattccgcggataagctccgcggccctccgttcgtgtcctcactacggtccgcagagcttatccgcggccgttctaggtaaagaac

SEQ ID NO: 17463 - RNA, 155 nt, unidentified
  source 1..155: mol_type = other RNA; note = Related to JAGMZN010000009.1; note = Acidovorax sp.
gctttttagctaaagacttaaaagcttagtcgggcgctccgccagactctatttcattgtttggatttattccgcagagaagctctgcgagcctacgttcgcaagctctctccgactcgcagatcttctctgcggtcgattcttggtaaagacac

SEQ ID NO: 17464 - RNA, 164 nt, unidentified
  source 1..164: mol_type = other RNA; note = Related to NZ_KI911557.1; note = Methylomonas sp.
ttctttacgcgaataaagcttaaaagtataaacatacttagcttagtcgggcgtttagccagactctttagaattgcttggacttattccgcagatacactctgcggccctccgtttgcactccggtccacagagtgtatctgcggttgatcttggtaaagaac

SEQ ID NO: 17465 - RNA, 174 nt, unidentified
  source 1..174: mol_type = other RNA; note = Related to NZ_BMXS01000014.1; note = Halomonas qijiaojingensis
gttctttagcgtttctgactaacaagtactgtttgacttgttagtttagtcgggcgattagccagactcaaaatattgcttggttttatgaccgcagatgacttctgcggatctacattcgcaagctcattccgatccgcagaagtcatctgcggccggttcaggtaaaggaca

SEQ ID NO: 17466 - RNA, 172 nt, unidentified
  source 1..172: mol_type = other RNA; note = Related to JABJWH010000040.1; note = Alcanivorax profundimaris
gctctttagcgtttgagcttacacattaatcgtgctgtgagcttagtcgggcgataagccagactcaaagtattgcttgcatttatggccgcagataccttctgcggctctacattcgcaagctcattccgacccgcagaaggtatctgcggccggcttcaggtaaagagct

SEQ ID NO: 17467 - RNA, 169 nt, Pseudomonas sp.
  source 1..169: mol_type = other RNA; note = Related to VOJF01000050.1; note = Pseudomonas aeruginosa
gtccttacgcgatcatagccacaagggactcccttaaggcttagtcgggcgcttcgccagactcaaatgcattgcttcgatttattccgcagagaatgtctgcgggcctacgatcgcaagcgatctccaacccgcagccatcctctgcgggcggtccgaggtgagggca

SEQ ID NO: 17468 - RNA, 169 nt, Pseudomonas sp.
  source 1..169: mol_type = other RNA; note = Related to NZ_UATW01000001.1; note = Pseudomonas aeruginosa
gtccttacgcgatcaaagccacaaggtacgcccttaaggcttagtcgggcgtttcgccagactcaaatgcattgcttcgatttattccgcagagaatgtctgcgggcctacgatcgcaagcgatctccgacccacagacattctctgcgggcggtccgaggtgaggaca

SEQ ID NO: 17469 - RNA, 169 nt, Pseudomonas sp.
  source 1..169: mol_type = other RNA; note = Related to NZ_CP015992.1
gtctttacgcgattaaagcctacagttctctaacttgtggcttagtcaggcgatacgccagactcaaatgcattgcttggttttattccgcagagaagatctgcgggcctacactcgcaagctcattccgacccgcagatcttctctgcggctgtccgaggtaaagaca

SEQ ID NO: 17470 - RNA, 156 nt, unidentified
  source 1..156: mol_type = other RNA; note = Oceanospirillaceae bacterium; note = Related to PBYC01000020.1
gactttacgcgaataaagccagttggcttagtcaggcgaatcgctagactctattttattgcgatgttttatcccgcagatatcacctgcggctatccgttcgcaagctcactactatccacaggcaatatctgcggttggtacaaggtaaagtac

SEQ ID NO: 17471 - RNA, 156 nt, unidentified
  source 1..156: mol_type = other RNA; note = Related to JALE01000028.1; note = Thalassolituus oleivorans
aactttacgcgaatagagccatttggcttagtcaggcgaatcgctagactctatgttattgcgaagatttatcccgcagatatgtgctgcggttatccgttcgcaagctcactactaaccacaccccacatctgcggttggtacaaggtaaagtta

SEQ ID NO: 17472 - RNA, 150 nt, unidentified
  source 1..150: mol_type = other RNA; note = Related to DNYL01000221.1; note = Halomonas sp.
ccttttacgcgtacagaaatagccgggtgtatagccaggctcaaaagaaattgggtatatttaatccgcatgtcttgctgtgtggcttgctgcggaaccccatgcagcaagccacacagcaagacatgcggctgcatcttggtaagaggt

SEQ ID NO: 17473 - RNA, 150 nt, unidentified
  source 1..150: mol_type = other RNA; note = Related to NZ_SOCZ01000001.1; note = Halomonas alkaliantarctica
ccttttacgcgttcagtatttgccgggtgtatagccaggctcaaatgaaattgggtatatttaatccgcatgtcttgctgtgtggcttgctgcggaaccccatgcagcaagccacacagcaagacatgcggctgcatcttggtaagagga

SEQ ID NO: 17474 - RNA, 165 nt, unidentified
  source 1..165: mol_type = other RNA; note = Related to NZ_ONZI01000001.1; note = Kushneria phyllosphaerae
ctttttacgcgttcattagcaattttttagctatagccgggtgtatagccaggctcaaaagcgattggagagatttattccgcatagaaatgctgcgggttttcgctccgcttcgctccactcgaacccgcagcatttctatgcggctgcttcgtggtaaaaagc

SEQ ID NO: 17475 - RNA, 168 nt, unidentified
  source 1..168: mol_type = other RNA; note = Related to CP026050.1; note = Serratia marcescens
gctctaaacgtgtatggcatatttagttatgcttgtcgggcgcttagccagacacttttatattgaacggctttagggttgcgcttggtgtgcctctggattgcactcctagttgcacgtcgtcgcgcaatccagaggcacaccaagcgcttcctctaggtaagagca

SEQ ID NO: 17476 - RNA, 165 nt, unidentified
  source 1..165: mol_type = other RNA; note = Related to CP034474.1; note = Pantoea agglomerans
gctctttagcgtggtatggatttcaccactcaacggttaaatctagttcggcgttacgcagaactctaacttattgattatatttacagttgcggaacaaaatttctgaaccgcagccgtagttgcggatcagaaattttgttccgcggctactagtaaagagca

SEQ ID NO: 17477 - RNA, 152 nt, unidentified
  source 1..152: mol_type = other RNA; note = Related to NZ_CP021235.1; note = Pontibacter actiniarum
ttgaattagtttttaaactttaatttaattaaagttttgtcgggtgtaaaccagacacttattgtattttttacctttggaagcaagctaataagctgttgctccccaaggggagcaacagcttattagcttgcttccctttgtaattcgat

SEQ ID NO: 17478 - RNA, 142 nt, unidentified
  source 1..142: mol_type = other RNA; note = Related to NZ_RCTY01000045.1; note = Lysobacter enzymogenes
taggtttatcgcataccagcgaccaggagtagctccggtctaatgtctggtccctagggcgttttatcaatttacgtatgcccggtcgctggcccacgcccgaccgggcatttcgtatgtgcattcgtgactggcaatcgac

SEQ ID NO: 17479 - RNA, 138 nt, unidentified
  source 1..138: mol_type = other RNA; note = Related to LDJG01000003.1; note = Stenotrophomonas nitritireducens
taggcttttgccataccagcgactaggagtagctccggtctaaggtctggtccctagggcgttttatcaacttacgcatgcccggtcgcaggctaacgcccgaccgggcatttcgtttttgcagctctagccggtaat

SEQ ID NO: 17480 - RNA, 142 nt, unidentified
  source 1..142: mol_type = other RNA; note = Related to NZ_LNSU01000266.1; note = Xanthomonas translucens
taggattttcgcataccagcgactaggagtagctccagtctaatgtctggtccctagggcgtttcatcaacttacgcatgcccggtcgcaggctaacgcccgaccgggcatttcgtatgtgcggtcctggcccgtaatgggc

SEQ ID NO: 17481 - RNA, 145 nt, unidentified
  source 1..145: mol_type = other RNA; note = Related to AM920689.1; note = Xanthomonas campestris
tagagttttttcataccagcgactaggagtagctccggtctaatgtctggtccctagggcgtttcatttatttacgtgtgcccggtcgcaggctaacgcccgaccgggcatttcgtttgtgcagtcctagcaggtaatcggatac

SEQ ID NO: 17482 - RNA, 148 nt, unidentified
  source 1..148: mol_type = other RNA; note = Related to LOKH01000144.1; note = Xanthomonas campestris
tagggtttacgcataccagcgaccaggagtagctccggtagctccggtctaatgtctggtccctagggcgtttcatcaacttacgcatgcccggtcgcaggctgaagcccgaccgggcatttcgtatgtgcagtgtcggccatcaatc

SEQ ID NO: 17483 - RNA, 145 nt, unidentified
  source 1..145: mol_type = other RNA; note = Related to FPCI01000001.1; note = Pseudoxanthomonas sp.
taggtttaccccacaccagcgaccaggagtagctccggtctaatgcctggtccctacggcgttttatcaatttacgtatgcccggtcgaaggcccatgtccgaccgggcatttcgtatgcgcagttctcctcggcaatcggctac

SEQ ID NO: 17484 - RNA, 143 nt, unidentified
  source 1..143: mol_type = other RNA; note = Related to CP076254.1; note = Xanthomonas translucens
taggctttttccataccagcgactaggagtagctccagtctaatgtctggtccctagggcgttttatcaacttacgcatgcccggtcgcaggcttacgcccgaccgggcatttcgtatgtgcgctttagaaggggcaatcggc

SEQ ID NO: 17485 - RNA, 147 nt, Achromobacter sp.
  source 1..147: mol_type = other RNA; note = Related to NZ_FNYM01000002.1
taacctcttttcataccagcgactaggagtagctccagtctaatgtctggtccctagggcgatttatcacatttacgaatacccggtcgaggctcacacccggccgggtttttcgtatgtactttccgcgttcctatcgattagcga

SEQ ID NO: 17486 - RNA, 143 nt, Alcaligenes sp.
  source 1..143: mol_type = other RNA; note = Related to NZ_CP032153.1; note = Alcaligenes aquatilis
tagagtcaaagcataccagcgactaggagcagctccagtcaaacgtctggtccctagggcgttttattaaatttacgcatgcccggtcgatggcgaaagcccgaccgggcgtttcgtatctgccagtagttaagtgtctatca

SEQ ID NO: 17487 - RNA, 144 nt, unidentified
  source 1..144: mol_type = other RNA; note = Related to NZ_PKQQ01000003.1; note = Stenotrophomonas sp.
taggatttttgcataccagcgactaggagtagctccagtcaacagtctggtccctagggcgtttcatcaatttacgcatgcccggtcgcaggctcacgcccgaccgggcatttcgtttgtactctccgaaggcgctcgtggcga

SEQ ID NO: 17488 - RNA, 142 nt, unidentified
  source 1..142: mol_type = other RNA; note = Related to NZ_PKQP01000016.1; note = Stenotrophomonas bentonitica
taggattttttcataccagcgactaggagtagctccagtcaacagtctggtccctagggcgtttcattgatttacgcatgcccggtcgcaggctcaggcccgaccgggcatttcgtatgtgccgccccaagcgacaatcggc

SEQ ID NO: 17489 - RNA, 143 nt, unidentified
  source 1..143: mol_type = other RNA; note = Related to NZ_VLLB01000004.1; note = Massilia lurida
tagaatttttgcataccagcgactaggagcagctccggtctaatgtctggtccctagggcgatttatgaatttacgtgtgcccggtcgctggctagcgaccgggcatttcgtatttgggattcgatccgaagaggtcaacgcc

SEQ ID NO: 17490 - RNA, 144 nt, unidentified
  source 1..144: mol_type = other RNA; note = Related to SZUV01000002.1; note = Acidithiobacillus thiooxidans
tataatctttctacaccagcgactaggagtagctccggtcaaatgtctggtccctagggcgttttatcaacttacgtatgcccggtcgcaggcttatgcccgaccgggcatttcgtatgcgttacctacagactacaatcaact

SEQ ID NO: 17491 - RNA, 143 nt, unidentified
  source 1..143: mol_type = other RNA; note = Related to NZ_CP028901.1; note = Orrella marina
tacagtttttccataccagcgactaggagtagctccagtctaatgtctggtacctagggcgttttatcaacttacgcgtgcccggtcgaaggcttgtgctatgttcggccgggtatttcgtaaatgccaacgggctgcagtca

SEQ ID NO: 17492 - RNA, 146 nt, Pseudomonas sp.
  source 1..146: mol_type = other RNA; note = Related to CP053705.1; note = Pseudomonas aeruginosa
tatgcttttcttacaaaccagcgactaggagtagctccagtctaatgtctggtaggtagggcgttttatctaacttacgcatgcccggtcgcaggcttacgcccgaccgggcatttcgtatgcgttatttacaggatgtagacagc

SEQ ID NO: 17493 - RNA, 143 nt, unidentified
  source 1..143: mol_type = other RNA; note = Related to JADMJL010000080.1; note = Methyloversatilis discipulorum
tacgctttttctataccagcgactaggagtagctccggtctaatgtctggtccctagggcgttttatctacttacgcatgcccggccgcaggctaacgcccggccgggcgtttcgtatctgtcatttgcaggctgctattagt

SEQ ID NO: 17494 - RNA, 144 nt, unidentified
  source 1..144: mol_type = other RNA; note = Related to CP086344.1; note = Halomonas sp.
tactgtaaaaacataccagcgactaggagtagctccagtctaaagtctggtccctaggtggttttatccgcttacgtatgctcggtcaatggctttcgcctgaccgagcatttcgtatgtgcagaggaaagtacatatttatta

SEQ ID NO: 17495 - RNA, 147 nt, unidentified
  source 1..147: mol_type = other RNA; note = Related to NZ_JAKPBV010000013.1; note = Lysobacter sp.
tagcctgttgtcatgccagcgactaggagtagctccggtcaacagtctggcctctatggcgctttagcaacttacgtatgcccgacctcaaggcctcgtgccgggtcgggcatttcgtttgtgctccaatatccaccatgacagatc

SEQ ID NO: 17496 - RNA, 147 nt, unidentified
  source 1..147: mol_type = other RNA; note = Related to LPEM01000032.1; note = Burkholderia cepacia
tagaatgcattcatgccagcgactaggagtatcctccagtcccaagtctggcctctaccgggtctgcatccatttacgtgtgggcgattccttaatgctaaggagtcgcccatttcgtatgtgctttgcgtgtaagcactctccccc

SEQ ID NO: 17497 - RNA, 145 nt, unidentified
  source 1..145: mol_type = other RNA; note = Related to NZ_UWYX01000002.1; note = Burkholderia gladioli
tagaatgttcctatgccagcgactaggagtatcctccagtcccatgtctggcctctaccgggtctgcatccatttacgtgtgggcgattccttattattaaggagtcgcccatttcgtatgtgtattgcgtgcaagcgccccttc

SEQ ID NO: 17498 - RNA, 146 nt, unidentified
  source 1..146: mol_type = other RNA; note = Related to NZ_BBJH01000023.1; note = Paraburkholderia heleia
tatagtaggatcatgccagcgaccaggagtatcctccggtccgaagtctggcctctaccgggtctgcatatatttacgtgtgggcgacgccttaaatttaaggggtcgcccatttcgtatgtgcgcggcacggcgctccgtcctat

SEQ ID NO: 17499 - RNA, 146 nt, unidentified
  source 1..146: mol_type = other RNA; note = Related to VZQP01000011.1; note = Paraburkholderia sp.
tagaatggtgctatgtcagcgactaggagcatcctccggtctgaagtctggcctctaccgggtctgcatttacttacgtgtgggcgattccttagtgttaaggagtcgcccatttcgtatgtgctccgcgtgcaagctccgctctc

SEQ ID NO: 17500 - RNA, 144 nt, unidentified
  source 1..144: mol_type = other RNA; note = Related to NZ_JAAVUQ010000005.1; note = Caballeronia sp.
tacaatgcactcacgccagcgaccaggagtatcctccggtcaaacgtctggcctctacccggtctgcatccagttacgtgtgggcgattccttaaattaagggatcgcccatttcgtatgcgtttcgttcgcgggcaaatctcc

SEQ ID NO: 17501 - RNA, 146 nt, unidentified
  source 1..146: mol_type = other RNA; note = Related to NZ_CYGX02000017.1; note = Paraburkholderia ribeironis
tacaataaggttatgtcagcgaccaggagcattctccggtcatatgtctggcctctaccgggtctgcatccatttacgtgtgggcgattccttgatgacaaggagtcgcccatttcgtatgggcctcccggtcagtccggttcgcc

SEQ ID NO: 17502 - RNA, 143 nt, unidentified
  source 1..143: mol_type = other RNA; note = Related to NZ_CP045094.1; note = Burkholderia sp.
tagaataagaccatgccagcgactaggagtatctccagtcttaggtctggcctctaccgggtctgcatcaatgttacgtgtgggcgatttcttgatttcaaggagtcgcccatttcgtatgaaagtccaatcgtttcgaactg

SEQ ID NO: 17503 - RNA, 140 nt, unidentified
  source 1..140: mol_type = other RNA; note = Related to JAHYBY010000004.1; note = Janthinobacterium sp.
tataattagcacatgccagcgactaggagcatctccagtcacattgctggcctctagggtgttgtctatttacggttgtgcggtgcctttttgtgtggcaccgcacaatttgtaatttcagatattccgccctactccaa

SEQ ID NO: 17504 - RNA, 146 nt, unidentified
  source 1..146: mol_type = other RNA; note = Related to NZ_QUBS01000013.1; note = Trinickia diaoshuihuensis
taggctactgttatgccagcgactaggagtatctccagtcttatgtctggcctctcccggctctgcatccactttacgattgggcggtgcgcctctttgaggtcgccgcccaaattgtaaatgctgtcaaaaagcgagaccttctc

SEQ ID NO: 17505 - RNA, 145 nt, unidentified
  source 1..145: mol_type = other RNA; note = Related to JAJUBG010000007.1; note = Caballeronia sp.
tatgctctttgcatgccagcgactaggagcatctccggtctcaagtctggcctctcccggctctgcatccactttacgattgggcggtgcgcttcttcgaggccgccgcccaaattgtaactgctgccggcaacccccttctcgc

SEQ ID NO: 17506 - RNA, 159 nt, Pseudomonas sp.
  source 1..159: mol_type = other RNA; note = Related to JAEKFF010000008.1
tactatgcctctatgtcagtgactaggggtatctccagtcgttaagctgacctctagaggtcttgatccatgttacgtttgtatggcctccctgctaggttatcgtttgagcagggtggccatgcgaattgtaaagtttgctcccttccgcatcttctc

SEQ ID NO: 17507 - RNA, 157 nt, Pseudomonas sp.
  source 1..157: mol_type = other RNA; note = Related to NZ_UUGY01000017.1; note = Pseudomonas viridiflava
tagcctcaacctatgtcagtgactaggggtatctccagtcgttaagctgacctctagaggtcttgatcaatgttacatttgtgtggtctccctgttaaattttggtttaaacggggagaccatgcggattgtaaaatatatatattttgtttcactt

SEQ ID NO: 17508 - RNA, 160 nt, Pseudomonas sp.
  source 1..160: mol_type = other RNA; note = Related to NZ_JABWRD020000002.1; note = Pseudomonas shirazensis
taccatgaccccatgtcagtgactaggggtatcctccggtcaataagctgacctctagaggtcttgatccatgttacatttgtatggcctccctgctctgtagtcgtttgagtggggggccatgcagactgtaaacgcctctataagtcctctcctccgc

SEQ ID NO: 17509 - RNA, 160 nt, Pseudomonas sp.
  source 1..160: mol_type = other RNA; note = Related to CP047592.1; note = Pseudomonas aeruginosa
taccatgaccccatgtcagtgactaggggtatcctccagtcatcaagctgacctctagaggccttgatccatgttacatttgtatggcttccctcctcgttcaccatttgagttgggaagccatgcagactgtaaaatcccgtctcctctgcagctctcc

SEQ ID NO: 17510 - RNA, 152 nt, Pseudomonas sp.
  source 1..152: mol_type = other RNA; note = Related to NZ_JACYNP010000006.1; note = Pseudomonas lutea
tacgatcgctccatgtcagcgatttggggtatccccggtcgtaagctgacctctacaggacttgatccttgttacatttgtctacctcccgggtgcggttgtgcccgggaggtaggacaaactgtaaacaccgtactaccccctctaaatat

SEQ ID NO: 17511 - RNA, 147 nt, Pseudomonas fluorescens
  source 1..147: mol_type = other RNA; note = Related to NZ_CABVHI010000016.1
taggattgccgcatgtcagcgatttggggtatccccggtcgtaagctgacctctacaggacttgatccatgttacatttgtgtaccttcccaggttgctgggaaggctacacaaactgtaaatcctgctcctattaacaccttctac

SEQ ID NO: 17512 - RNA, 152 nt, Pseudomonas sp.
  source 1..152: mol_type = other RNA; note = Related to FNTC01000002.1; note = Pseudomonas jessenii
tagtatctgtggcatgtcagcgattggggaatcttccagtcgtatgctgacctctacaggccttgatccgtgttacatttgtgtgcctcctacgtactcagcgtcgggaggttacacaaactgtaagcctctccctcctatcctctcgtact

SEQ ID NO: 17513 - RNA, 153 nt, Pseudomonas sp.
  source 1..153: mol_type = other RNA; note = Related to NZ_CP052862.1
taggatctcttcatgtcagtgactaggagcatctccagtctcaagctgacctctaaaggcctgtatccgagttacttttgtgtgacttccccaatctgctgattgagggaagccgcacgaacagtaaaatttgcgttacccgtaacccccttc

SEQ ID NO: 17514 - RNA, 151 nt, Pseudomonas sp.
  source 1..151: mol_type = other RNA; note = Related to NZ_LT629777.1; note = Pseudomonas asplenii
tacgatctttgtatgtcagtgactaggagtatctccagtcgcaagctgacctctagaggcctgtatccgtgttacttttgtgtgacttccccattttcttgactggggaagccgcacgaatagtaaagcagcccttattttttctcccccc

SEQ ID NO: 17515 - RNA, 159 nt, Pseudomonas sp.
  source 1..159: mol_type = other RNA; note = Related to NZ_LT607553.1
tacgatcagttcatgtcagtgactaggagtatctccagtcgcaagctgacctctaaaggcctgtatccgatttacttttgtgtgaagccccctctgtctagctttggctaacggttgggggacacacaaatagtaaacttaagtcttaatccgaaatct

SEQ ID NO: 17516 - RNA, 141 nt, unidentified
  source 1..141: mol_type = other RNA; note = Related to NZ_CP089507.1; note = Luteimonas sp.
taccatcgggtcatgtcagcgaccaggagcatctccggtcaccagtctgacctctaggccgtttaattaactttacatttgcgcggtctgcatttggcaggccgcgcgaactgtaaaacaacagcctacttatgtgtctgc

SEQ ID NO: 17517 - RNA, 176 nt, Pseudomonas sp.
  source 1..176: mol_type = other RNA; note = Related to NZ_QPDS01000008.1; note = Pseudomonas cichorii
taccatcctgctcatgtcagcgactaggagtatctccagtcggtttggaatgctggcctctacaggtgtctagtctccgtcttacgtttgtgtaggtctatgctgggtctgggtgagtaactgactgcatagacctacacggatagtaaggagtcgtaataagcatcaatgagttc

SEQ ID NO: 17518 - RNA, 159 nt, Pseudomonas sp.
  source 1..159: mol_type = other RNA; note = Related to NZ_JACVHC010000006.1; note = Pseudomonas anatoliensis
tatagtctcttcatgccagtgactaggagtacctccagtcggtttggaatgctggcctctacaggtgtctagtctccgtcttacgtttgtgtgggttaatgctgagcaaaacggcattggcctacacagatagtaagggctatcaagtcccggttcagc

SEQ ID NO: 17519 - RNA, 171 nt, Pseudomonas sp.
  source 1..171: mol_type = other RNA; note = Related to NZ_CP023969.1
tatcatccacgcatgtcagtgactaggagtatctccggtcggtttgtaatgctggcctctacaggtgtctagtttccgtcttacgtttgtgtaggtttatgcttggtggaaatattctactaacataagcctacacagatagtaaggaacacttcctccgcctcccagcac

SEQ ID NO: 17520 - RNA, 161 nt, Pseudomonas sp.
  source 1..161: mol_type = other RNA; note = Related to RHQR01000004.1
tatgatcaggtcatgccagtgactaggagtatctccagtcggtttggaatgctggcctctacaggtgtctagtctccgtcttacgtttgtgtaggtttatgttgaaaacagcatatgcctgcacagatagtaaggagcaaaaattagattctccgtagctt

SEQ ID NO: 17521 - RNA, 159 nt, Pseudomonas sp.
  source 1..159: mol_type = other RNA; note = Related to JAEKED010000001.1
tatgatctgatgcatgtcagtgactaggagaatctccagtcggtttggaatactggcctctacaggtgtctagtctccgtcttacgtttgtgtagggttatgcagggtaagtaactgcataaccttgcacagatagtaaggagccctccagcagcacct

SEQ ID NO: 17522 - RNA, 153 nt, Pseudomonas sp.
  source 1..153: mol_type = other RNA; note = Related to LIHT01000076.1; note = Pseudomonas syringae
tatatttgcctcacgccagcgactaggagcagctccagtcaataatgttggcctctacaggtatctagtctccgtcttacgtttgtgcatgctgagtggtcgtaggccagtcagcatgcacggatagtaagggtaatatctctgacatcccgc

SEQ ID NO: 17523 - RNA, 156 nt, Pseudomonas sp.
  source 1..156: mol_type = other RNA; note = Related to PGRY01000001.1
tatagtcagtgcatgtcagcgactaggagcatctccagtcacaaatgctggcctctataggtgtctagtctccttcttacgctgcgaggggttcatttgaatatttttgaactcctcgcatgtagtaagcccaaaaagaactgctaactactttct

SEQ ID NO: 17524 - RNA, 164 nt, Pseudomonas sp.
  source 1..164: mol_type = other RNA; note = Related to CP017149.1; note = Pseudomonas aeruginosa
tatgatcaccttatgccaagactaggagcagctccagtcacaaatggcctctacagtcgtctagtctcctgtttacgtttgtgttgccctttaggctcggctcgggctcgatgcctaaagggcttcacaaatagtaaatccccgctccccgctccccgctcccc

SEQ ID NO: 17525 - RNA, 141 nt, unidentified
  source 1..141: mol_type = other RNA; note = Related to JAHTGR010000011.1; note = Duganella sp.
tagaatagcggcatgtcagcgactaggagcatctccagtcttgagcctgacctctatcgggtatgattaagttacgattgtgcgtgtcccaagttggggcacgcacatattgtaaatttttctccctatcactttccctcc

SEQ ID NO: 17526 - RNA, 154 nt, Pseudomonas sp.
  source 1..154: mol_type = other RNA; note = Related to LIRD01000002.1
tagagtcatcccatgccagtgactaggagcatctccagtcatcagatctggcctctacaggtatctagtctccgctttacatttgtgtgcctctctagcgaatggctaaagaggcacataaatagtaaatactcttgatcgatttctcttctcc

SEQ ID NO: 17527 - RNA, 153 nt, Pseudomonas sp.
  source 1..153: mol_type = other RNA; note = Related to NZ_MUNM01000090.1
tagagtcggcctatgccagtgactaggagtatctccagtcgccaaatctggcctctacaggtgtctagtctccgctttacgtttatgtgcctctctagcaaaaggctaaagaggcacataaatagtaaatatcttcttgattttcgctgctct

SEQ ID NO: 17528 - RNA, 155 nt, Pseudomonas sp.
  source 1..155: mol_type = other RNA; note = Related to AKJS01000163.1
tagagtcggtctatgccagtgactaggagtatctccagtcgccaaatctggcctctacaggtgtctagtctccgctttacgtttatgtgcctctctagcaataagctaatgaggcacataaatagtaaagatctccgttttatcctcctagctac

SEQ ID NO: 17529 - RNA, 153 nt, Pseudomonas sp.
  source 1..153: mol_type = other RNA; note = Related to NZ_FYEA01000001.1
tagagtccgactcatgccagtgactaggagcatctccagtcatcaaatctggcctctacaggtgtctagtctccttttacgtttgtgtgtctctctagcagtcagctaggaggcacacagatagtaaactctgcctttcaagcaggcgtattc

SEQ ID NO: 17530 - RNA, 150 nt, Pseudomonas sp.
  source 1..150: mol_type = other RNA; note = Related to NZ_CP062253.1; note = Pseudomonas gozinkensis
tacagtccgagtcatgccagtgactaggagcatctccagtcatcaaatctggcctctacaggtgtctagtctccttttacgtttgtgtgccttttagcgttgagctaagaggcacacaaatagtaaaacctcctacgcaagcagacagtt

SEQ ID NO: 17531 - RNA, 146 nt, Pseudomonas sp.
  source 1..146: mol_type = other RNA; note = Related to NZ_CP077087.1; note = Pseudomonas monsensis
tagagttcgactcatgccagtgactaggagcatctccagtcatcaaatctggcctctacaggtgtctagtctccttttacggttgtgtgcctctttagcgaaacgctaagaggcacacaaattgtaaactttgttttcttggttac

SEQ ID NO: 17532 - RNA, 154 nt, unidentified
  source 1..154: mol_type = other RNA; note = Related to NZ_MPIO01000005.1; note = Atopomonas hussainii
tatactgcatgcatgtcagcgactaggagcatctccagtcatcagcctgacctctagtcgcctttatctggttttactgttgtgtggctcgctagcgaaatcctctagcgagccacacaaatagtaaaaaatccagttttctgcttttgcatct

SEQ ID NO: 17533 - RNA, 148 nt, Pseudomonas sp.
  source 1..148: mol_type = other RNA; note = Related to NZ_JAHSTU010000002.1; note = Pseudomonas azerbaijanoccidens
tatcatttgggcatgtcagcgactaggagtatctccagtcattcagctggcctctacatgcctttagttatttactgttgtgtggttcccttctcaaatcgagggggagccacacgaatagtaaggcttgtactccatctagcagctc

SEQ ID NO: 17534 - RNA, 143 nt, Pseudomonas sp.
  source 1..143: mol_type = other RNA; note = Related to SCFF01000003.1
tatgatttaggtatgtcagcgactaggagcatctccagtcatccagctggcctctacaggtctatatccggttactgttgtgtggtcatcctatctttgggatggccacacgaatagtaatgtttattttgatgtcaagaatt

SEQ ID NO: 17535 - RNA, 150 nt, Pseudomonas sp.
  source 1..150: mol_type = other RNA; note = Related to NZ_CP039631.3; note = Pseudomonas veronii
tatcattggcgcatgtcggcgactaggagtatctccagtcactcagctgaccgctacaggcctttaattgtttactgttgtgtggtctttccattttttggtgggaaggccacacgaatagtaaggccgaaatggtatcaaaaacctttc

SEQ ID NO: 17536 - RNA, 134 nt, unidentified
  source 1..134: mol_type = other RNA; note = Related to JADMKF010000239.1; note = Aquabacterium sp.
tacactatacgcatgtcaacgactaggagcatctccagtcagctatgttgacctctaggccgtctgatctacttgtgtggcgcccccttgcggggcgccacacaagacgtagaacgaaacggacgacgcccgcc

SEQ ID NO: 17537 - RNA, 146 nt, unidentified
  source 1..146: mol_type = other RNA; note = Related to NZ_FOKN01000013.1; note = Delftia tsuruhatensis
tacactatacccatgtcaacgaccaggagcatctccggtcgctagtcactgactaaagttgacctctaggccgtctgatctacttgtgtggcgtactgttcagtacgccacacaagctgtagagtccactcagacccgcgcccccc

SEQ ID NO: 17538 - RNA, 142 nt, unidentified
  source 1..142: mol_type = other RNA; note = Related to NZ_SZVI01000009.1; note = Rhodoferax sp.
tagactatacgcatgtcagctgactaggagcatctccagtcataaggctgacctctaggccgtctgatctacttgtgtggcgtgctcggtttaccgagcacgccacacaaggcgtagaggctctttctccatcatttatcat

SEQ ID NO: 17539 - RNA, 141 nt, unidentified
  source 1..141: mol_type = other RNA; note = Related to NZ_BADL01000521.1; note = Ideonella sp.
taaaatgcgccccatgtcagctgactaggagcatctccagtcgtttaggctgacctctaggccgtctgatctacttgtgtggcgcgcttggtaatgtccaagccgccacacaagacgtagagcgatggtctccttcgcggt

SEQ ID NO: 17540 - RNA, 138 nt, unidentified
  source 1..138: mol_type = other RNA; note = Related to JACUZW010000001.1; note = Comamonas sp.
taaaattgaccccatgtcagctgactaggagcatctccagtcatataggctgacctctaggccgtctgatctacttgtgtggtgagcttacgccaagctcgccacacaaggcgtagaagatcaacgtctcagatccga

SEQ ID NO: 17541 - RNA, 139 nt, unidentified
  source 1..139: mol_type = other RNA; note = Related to JAEQNE010000002.1; note = Ramlibacter monticola
tacaattcgcacatgccagcgaccaggagtatctccggtcacacgtgctggcctctacggcgtctggatctacttgtgtggtgagccttcgtggctcccacacaagatgtagaagccgccaacatctctgctgtcttcc

SEQ ID NO: 17542 - RNA, 143 nt, unidentified
  source 1..143: mol_type = other RNA; note = Related to CP039287.1; note = Cupriavidus necator
tatactagcaaaatgccagccgactaggagtagctccagtcacataggctggcctctaggccgtctgatctacttgtgtggcgtgcccatgtcaatgggccgccacacagggcgtagattcctcctctcttccccccgatttt

SEQ ID NO: 17543 - RNA, 152 nt, unidentified
  source 1..152: mol_type = other RNA; note = Related to CP035708.1; note = Sphaerotilus natans
tagcatagcttcatgctggctgactaggagtatctccggtcgcacaggccagcctctaggccgtctgaatctacttgtgtgatgcgcttgacccagggtgagccgggacaggtgctcacacaaggcgtagatcggtacatcagcgcaacaat

SEQ ID NO: 17544 - RNA, 151 nt, unidentified
  source 1..151: mol_type = other RNA; note = Proposed Ferrovum myxofaciens; note = Related to NZ_JPOQ01000093.1
tatagtgaccaaatgctggctgactaggagtatctccggtcgcaaaggccagcctctaggccgtctgattctactgcgtgtgcccccccgtgtacaggacttctgtacacggtgggggcacacgcaggatatagattgcaccatacttcct

SEQ ID NO: 17545 - RNA, 135 nt, unidentified
  source 1..135: mol_type = other RNA; note = Related to JACORU010000006.1; note = Ramlibacter sp.
tacaatagcgtcatgccagcgactaggagcatctccggtcataaacgttggcctctgaggcgtctgaatctacttgtgtggagaccacaggtctccacacaaggcgtagagttctagaggcttcgaacgggtgcc

SEQ ID NO: 17546 - RNA, 143 nt, unidentified
  source 1..143: mol_type = other RNA; note = Related to VSWE01000008.1; note = Herbaspirillum sp.
tataatcgcggcatgtcagtgactaggagtagctccagtcattctgctgacctctaggccgtctgattctaccaatttggttgcggggcttgaatcatattcaagccccgcaatagtagattcgcaaatcctccttctcctct

SEQ ID NO: 17547 - RNA, 146 nt, unidentified
  source 1..146: mol_type = other RNA; note = Related to NZ_KV880769.1; note = Herbaspirillum camelliae
tataatcgcgccatgtcagtgactaggagtagctccagtcattctgctgacctctaggccgtctgattctaccaatttagttgcgtggcttgaaacttctcaagccacgcaatagtagaactccagatattcaggccttaaaaatc

SEQ ID NO: 17548 - RNA, 146 nt, unidentified
  source 1..146: mol_type = other RNA; note = Related to NZ_SDQC01000001.1; note = Pusillimonas soli
tataattgagttatgtcagtgactaggagtagctccagtcattttgctgacctctaggccgtctaattctacctaacttggttgcgtggcttgaatttgattcgagccacgcaatagtagatccaacaaacaaaatttcagattgc

SEQ ID NO: 17549 - RNA, 146 nt, Chromobacterium sp.
  source 1..146: mol_type = other RNA; note = Related to JAGKRE010000004.1; note = Chromobacterium violaceum
tatactaccatcatgtcagtgactaggagcatctccagtcgttatgctgacctctaggccgtctgattctaccaaattgattgcgtggtctgaaaccgatgttcagaccacgcaatagtagatatcccagatttgccgccaatccc

SEQ ID NO: 17550 - RNA, 153 nt, unidentified
  source 1..153: mol_type = other RNA; note = Related to NZ_JAGSPN010000010.1; note = Undibacterium luofuense
taggattaacgtatgtcagtgactaggagtagctccagtcgaaatgctgacctctccgccgtctgattctaccaaatttggttgcgtggcttaaattaattaacatttaagccacgcaatagtagattcccctcccgcagccaagctatatct

SEQ ID NO: 17551 - RNA, 136 nt, Vibrio parahaemolyticus
  source 1..136: mol_type = other RNA; note = Related to NNGJ01000068.1
tattatctagtcatgccggagactaggagtagctccagtcgttaactggcctctacctgagattataaatgttactaatgcacgtacattcgcaagaatgtcgtgcattttgtaattttggcctttggaaagctta

SEQ ID NO: 17552 - RNA, 134 nt, unidentified
  source 1..134: mol_type = other RNA; note = Related to MAJX01000042.1; note = Aliivibrio fischeri
tactatttaatcatgccggagactaggagtagctccagtcgctaactggcctctacctgagattataaattttactaatgcacgtacatttatgaaaatgacgtgcattttgtaattttgtcgtacggaaaact

SEQ ID NO: 17553 - RNA, 141 nt, Vibrio sp.
  source 1..141: mol_type = other RNA; note = Related to NZ_LNQW01000024.1; note = Vibrio jasicida
taacctattagtatgctagagactaggagtagctccagtcgttaactagcctctacctgcgtttaggtatgttacttgtgcacgtttcctttacaaaagggcgtgcattttgtaattctagcctctagaaactcatactgc

SEQ ID NO: 17554 - RNA, 137 nt, Vibrio sp.
  source 1..137: mol_type = other RNA; note = Related to CAOA01000134.1; note = Vibrio nigripulchritudo
tataatcagggcatgccggagactaggagtagctccagtcactaactggcctctacctgcgtttaggtgtgttactagtgcacgttccttcattggacgtgcattttgtaattttgggggacagaaaactaagatca

SEQ ID NO: 17555 - RNA, 153 nt, unidentified
  source 1..153: mol_type = other RNA; note = Related to NC_018012.1; note = Thiocystis violascens
taaactcaaagaatgctagcgactaggagcatctccagtcattcacgctagcctctacccggtgctgatctacttttgagtttgtgcgcccctctgacaatttgcagacggggcgcacaaatcgtagacatgcctctgctgtcggtctagtcg

SEQ ID NO: 17556 - RNA, 151 nt, unidentified
  source 1..151: mol_type = other RNA; note = Related to NZ_CP014222.1; note = Janthinobacterium sp.
tagtatcgagtcatgctagggactaggagtatctccagtcactaaacctagcctctagggcgctatatttagttacgtttgtgtgtactagcaatgcttcgttgcagctagtacacgcttttcgtaatattctaaaattctcgatcgtgta

SEQ ID NO: 17557 - RNA, 156 nt, unidentified
  source 1..156: mol_type = other RNA; note = Related to NZ_CP081150.1; note = Deefgea sp.
tattattgcactatgccaaggactaggagcatctccagtcgttagtcttggcctctactgcgctatagttagtttacgtcaggtgtgtgttatcaatgatctttcatcactggtaacacacaccagatacgtaaaaactcaatgccacttccccta

SEQ ID NO: 17558 - RNA, 160 nt, unidentified
  source 1..160: mol_type = other RNA; note = Related to JACJDS010000010.1; note = Pseudoalteromonas sp.
taaattgtcaacatacctagcgactaggagcatctccagtcattatgcaaggtcactacaagctatgaattatgttacccttacaccttattcctcgtctaagataagattgagtatagggtgtaagattgtaactttacttgtaactatctctagttaa

SEQ ID NO: 17559 - RNA, 149 nt, unidentified
  source 1..149: mol_type = other RNA; note = Related to LAZL01000002.1; note = Catenovulum maritimum
tatatttagtggcatacctagcgactaggagcatctccagtcagtatgcaaggtcactacaggctatgagtcatgttacccttacgccaattcgcctatctgtgtattggcgtaagaatgtaacctaccccttccttttcctttcagaa

SEQ ID NO: 17560 - RNA, 142 nt, unidentified
  source 1..142: mol_type = other RNA; note = Related to LKDV01000028.1; note = Pseudoalteromonas sp.
tatcattagttcataccatgcgactaggagtatctccagtcattatgcaaggtcactacaggctatgagtcatgttacatccgtgttggtactgatatttcagtccacacggaatagtaacagctaagttttttgaacataa

SEQ ID NO: 17561 - RNA, 146 nt, unidentified
  source 1..146: mol_type = other RNA; note = Related to NZ_QNQN01000070.1; note = Pseudoalteromonas sp.
tatcctaaacacataccatgcgactaggagcatctccggtcattttgcaaggtcactacaggctatgagtcatgttacgtccgtgtagatactctttgtgagttctacgcggaatagtaactctttctattactatcatttatcag

SEQ ID NO: 17562 - RNA, 152 nt, Vibrio sp.
  source 1..152: mol_type = other RNA; note = Related to JAATOR010000004.1; note = Vibrio diazotrophicus
tatctttgatacatacctagcgactaggagcatctccagtcaatatgcaggtccctacaggctataattaatgttacccttacgccgattgctcactagataccagcatttggcgtaagattgtaactctctactatcctcacgtcatccca

SEQ ID NO: 17563 - RNA, 154 nt, unidentified
  source 1..154: mol_type = other RNA; note = Related to NZ_RSEJ01000003.1; note = Photobacterium alginatilyticum
tatcttatggttatacctggtgactaggagtatctccagtcattatgctaggtccctacaggctataattaatgttgcccttacgtcatttactgtctaacaagttagtaaatgacgtaagaatgtaacctctatcttacgcttacgctcccac

SEQ ID NO: 17564 - RNA, 163 nt, unidentified
  source 1..163: mol_type = other RNA; note = Related to JADWMP020000001.1; note = Shewanella sp.
tagattcgacccatacctcgcgactaggagcatctccagtcattaagcaggtcactacgggtcatgaaccattttactgaatgcactcgtatcttgattaagtgctattacttattcagatacagtgcatgaaagtaagccaattcctcgaactattcagtgt

SEQ ID NO: 17565 - RNA, 155 nt, unidentified
  source 1..155: mol_type = other RNA; note = Related to CP027188.1; note = Idiomarina sp.
tatcataatcacatacccagcgactaggagtatctccagtcattatgcagggtccctacaggctatgagtcaatgttaccttgcgttactctttacgctcatttaaaagcataaagtgtagcgcaagctagtaactcgattagccgcgacaaccc

SEQ ID NO: 17566 - RNA, 163 nt, unidentified
  source 1..163: mol_type = other RNA; note = Related to NZ_JAJEWQ010000006.1; note = Planctobacterium marinum
tagattataaatataccagcgcgactaggagcatctccagtcacaaaggcgcaggtcactacgggctatgatgaatgttacccttgcaccattgttgatgttaactaccgttattaacacaacatggtgtaagcaagtaacccggccttcagtaaactcccaa

SEQ ID NO: 17567 - RNA, 140 nt, unidentified
  source 1..140: mol_type = other RNA; note = Related to BMQW01000002.1; note = Shewanella ulleungensis
tatgatctgtttatacctagcgactaggagtatctccagtcatcacgcaaggtcactacctgctgttattaatgttacgaccacatggcaagtgattgttatgtggtcaagtaacctcactctcagcactctcagcactc

SEQ ID NO: 17568 - RNA, 155 nt, unidentified
  source 1..155: mol_type = other RNA; note = Related to CP031769.1; note = Salinimonas sediminis
tatattatatgcataccttcgactaggagcatctccagtcacaaatgaaggtccctacgagctatgagtcatattacaactgcgctacgatgttttgggaatcaaaatattcgtagcgcaagtatgtaatgcaaactgtcgtaagtttacttctc

SEQ ID NO: 17569 - RNA, 148 nt, Vibrio sp.
  source 1..148: mol_type = other RNA; note = Related to DACQGG010000011.1; note = Vibrio vulnificus
tagaataactacatacctcgcgactaggagcatctccagtcattaagcgaggtccctacaggccatgagtcatgttaccctcatccttagctcactctcatagagttaaggatgagattgtaacccccccccccacccccacacctat

SEQ ID NO: 17570 - RNA, 142 nt, unidentified
  source 1..142: mol_type = other RNA; note = Vibrionaceae bacterium; note = Related to JAAEYZ010000024.1
taatataatgacataccacgcgactaggagcatctccagtcattaggcgaggtcactacaggccatgagtcatgttaccctcaccctgacctcataacgagtaagggtgagattgtaacctatttgcccgtcccccttctcc

SEQ ID NO: 17571 - RNA, 149 nt, Vibrio parahaemolyticus
  source 1..149: mol_type = other RNA; note = Related to JWSV02000003.1
taaaataaacgtataccacgcgactaggagtatctccagtcattaggcgaggtccctacaggccatgagtcatgttaccctcaccttgttctcatttttaatgagtcagggtgagattgtaaccacaccataaaccatgacatatccat

SEQ ID NO: 17572 - RNA, 144 nt, unidentified
  source 1..144: mol_type = other RNA; note = Related to NZ_LVDX01000004.1; note = Shewanella algae
taatcttcgaccataccacgcgactaggagtatctccggtcatatagcgaggtcactacaggctgtcatttatgttactcccacatccgagcactaaactcagatgtggggttagtaaccatctctcctcaagcccatctggtt

SEQ ID NO: 17573 - RNA, 139 nt, Vibrio sp.
  source 1..139: mol_type = other RNA; note = Related to NZ_CP091185.1; note = Vibrio anguillarum
tattatgtacgtaaccttgcgactaggagtatctccagtctttgagctaggtccctacaagccatgataaatgttaccctccgtgcaaaattaacattttgtgcggagattgtaaccaattctctgttcgttctgatct

SEQ ID NO: 17574 - RNA, 142 nt, Vibrio sp.
  source 1..142: mol_type = other RNA; note = Related to AAXNPA010000001.1; note = Vibrio cholerae
tatcatttactcatacctcacgactagaagcatcttcagtcactatgtgaggtccctacaggccatgagtcatgttaccttcctttcttctctctctagggggaaaggaagaatgtaaccttctaactttacctcttccctc

SEQ ID NO: 17575 - RNA, 127 nt, unidentified
  source 1..127: mol_type = other RNA; note = Related to JABXGE010000012.1; note = Raoultella terrigena
tattattaaaaaataccttgcgactaggagcatctccagtcactatgcaaggtccctacaggccatgattcatgttaccctccccctacgggggaggattgtaaccttctgattttcataacactta

SEQ ID NO: 17576 - RNA, 149 nt, unidentified
  source 1..149: mol_type = other RNA; note = Related to NZ_CP034660.1; note = Colwellia sp.
taatatttatacataccttgcgactaggagaatctccagtcaaaaatgtaaggtccctagccgttattattaagttacttgaagcgcagacataagattataattcttatactgcgcttttttgtaatccctactatgtatatagtctt

SEQ ID NO: 17577 - RNA, 156 nt, unidentified
  source 1..156: mol_type = other RNA; note = Related to NZ_CP041170.1; note = Alteromonas mediterranea
tatactatgtacatacctcgtgactagaagtaacttcagtcaaaaaattcgaggtcactaccggctatgattcagttactcttcactggggtgatttaaatgtttttaagttacctcagtgttaagtagtaaacctcatgaatcaaactaacgttt

SEQ ID NO: 17578 - RNA, 145 nt, unidentified
  source 1..145: mol_type = other RNA; note = Related to CP033381.1; note = Methylomonas sp.
tatactcagaaccatgctagtgactaggagtatctccagtcataaatactagcctctacctgcgtttagcctaatttatcttgcccgaactctttcagagacgggcaagttgaaatttgaggaacaatgccttttggtatagttc

SEQ ID NO: 17579 - RNA, 145 nt, unidentified
  source 1..145: mol_type = other RNA; note = Related to NZ_CP022129.1; note = Methylovulum psychrotolerans
tacacttaacagtatgctagtgactaggagtatctccagtcataaatactagccgctacctccgtttagcctaatttatcttgcccgaactctttcagagacgggcaagttgaaatttgacgaacattgcgatctggtgtcgttc

SEQ ID NO: 17580 - RNA, 161 nt, unidentified
  source 1..161: mol_type = other RNA; note = Related to MGYX01000019.1; note = Gammaproteobacteria bacterium RIFCSPLOWO2_12_FULL_47_76
tacattatctctatgctagcgactaggagtatctccagtcacatgtctagcctctacgggctataagccataattcatcttgtcctctaccctacgttccatgaattagcatggagtggggtagggcaagttgtatttttaaagtatagagttttactcaa

SEQ ID NO: 17581 - RNA, 148 nt, unidentified
  source 1..148: mol_type = other RNA; note = Related to JACUUH010000036.1; note = Gammaproteobacteria bacterium
tagcattcattacatgtcagcgactaggagtatctccagtcttcgtatactgacctctagtggttttaattcataatttgttttgtctttcccttaaggttctagggaaagacaaaatataatgacagtgactttattcaattgaaaa

SEQ ID NO: 17582 - RNA, 152 nt, unidentified
  source 1..152: mol_type = other RNA; note = Related to PJBZ01000069.1; note = Psychromonas sp.
taaaattaaggtcgctgaccgactaggagtatctccagtcatttgagttagcctctaaaagtaattagatatgtttcatcttgtctatcacacaatttttatgatgtgtgatagagcaagttgtaacctcaatatttaattagattagacga

SEQ ID NO: 17583 - RNA, 150 nt, unidentified
  source 1..150: mol_type = other RNA; note = Related to NZ_WTKU01000003.1; note = Psychromonas sp.
tataatatatttttgctgaccgactaggagtatctccagtcatctgagttagcctctaaaagtgattagaaatgtttaaccttgcctatccgcaactatataaaaatggccatggataggcaaagttgtaaatataatgttttaattagt

SEQ ID NO: 17584 - RNA, 146 nt, unidentified
  source 1..146: mol_type = other RNA; note = Related to JACUUF010000373.1; note = Methyloprofundus sp.
tataataaacccaacccagtgactagaggtatcctcggtctggcttcggcggctggtgagcagtggtttatagtatttataaaaaagccttggcaatttgttttgtcagggcttttttattggtgttataaacccaatcagttagc

SEQ ID NO: 17585 - RNA, 150 nt, Escherichia coli
  source 1..150: mol_type = other RNA; note = Related to CP028745.1
taaagtgtttttatgccaacgactaggagcatctccagtcataaatgttggcctctacaggcctttatatagtgttgctcttgtactgccttctctttcgagagaaggtatgtacaagaagtaaagcctgcgaagggagggtgtctgggg

SEQ ID NO: 17586 - RNA, 150 nt, Enterobacter sp.
  source 1..150: mol_type = other RNA; note = Related to NZ_CP006580.1; note = Enterobacter ludwigii
taaagtagctttatgccaacgactaggagtatctccagtcattaatgttggcctctacaggccttgatttagtgttgctcttgtactgccttctctcccgggggaaggtatgtacaagaagtaaggcctgtaaaagggagggtgtctggg

SEQ ID NO: 17587 - RNA, 155 nt, unidentified
  source 1..155: mol_type = other RNA; note = Related to NC_014562.1; note = Pantoea vagans
taaagtatctttatgccaacgactaggagaatctccagtcaaaaatgttggcctctacaagcctttatatagtgttgctcttgtactaccttcttctttgatatttgaagaaggtatgtacaagaagtaagggttttctacagctacagctacag

SEQ ID NO: 17588 - RNA, 149 nt, unidentified
  source 1..149: mol_type = other RNA; note = Related to NZ_CQDT01000017.1; note = Yersinia frederiksenii
tacgctaaattcatgctgacgactaggagtatctccagtcaccaatgtcggcctctacaagcctttaggtacgttactcttatgtcatcctcttcagcctgaagaggatgatgtaggtagtaaaaaaatacacaaactgtatgagtgat

SEQ ID NO: 17589 - RNA, 151 nt, unidentified
  source 1..151: mol_type = other RNA; note = Related to NZ_JXSK01000013.1; note = Photorhabdus luminescens
tatatttaacccatgctagcgactaggagtatctccagtcagcaatgttagcctctacgagcctttatgtaatgttactcttgtactgcccttcttcataaacctgaaaagggtatgtacaggtagtaaatttcaaagagaacgagccttt

SEQ ID NO: 17590 - RNA, 155 nt, Pseudomonas sp.
  source 1..155: mol_type = other RNA; note = Related to NZ_LR733826.1
taaaatgagggcatgtcagcgactaggagtagctccagtcaacagtctgacctctaggcgcctttatcctttttacgtttgtaccgctcttcttgatgcaaggcataagaagagcggtacaaatagtaaaaaacctcctcggcacctagcagcac

SEQ ID NO: 17591 - RNA, 150 nt, unidentified
  source 1..150: mol_type = other RNA; note = Proposed Pararheinheimera soli; note = Related to NZ_JAJOYU010000011.1
cataataatttcatgcttctgaccttggagcatctccggtcaatcaggaagcctctataggcagtatagtctcgtaaattactaaggctcccgttaagcaattatcgggggccttaataatttacaagacacgtaaaggtgcttcagtca

SEQ ID NO: 17592 - RNA, 151 nt, unidentified
  source 1..151: mol_type = other RNA; note = Related to CP048043.1; note = Serratia liquefaciens
cataataaccacatgcttctgaccttggagtatctccggtcaaacaggaagcctctataggcagtatagtctcgtaaattattaaggcccccgttaagcaattatcgggggccttaataattttcagataacgaaaaggcacttcagtcaa

SEQ ID NO: 17593 - RNA, 149 nt, unidentified
  source 1..149: mol_type = other RNA; note = Related to FWGN01000003.1; note = Klebsiella pneumoniae
cataatgacattatgcttctgacttggagtatctccggtcaaccaggaagcctctataggcagtatagtcaggtttattactaaggcccccgttaagcaattatcgggggccttagtaatttctgggccccagcaaggccttctgaccc

SEQ ID NO: 17594 - RNA, 148 nt, Escherichia sp.
  source 1..148: mol_type = other RNA; note = Related to LR134270.1; note = Escherichia marmotae
cataatgagcctatgcttctgacttggagtatctccggtcaaacaggaagcctctataggcagtatagtctcgtaaattattaaggctcccgtgaagtgattcttgggggccttaataatttatggggccgcaggtgcttcagtacat

SEQ ID NO: 17595 - RNA, 151 nt, unidentified
  source 1..151: mol_type = other RNA; note = Related to NITI01000005.1; note = Cronobacter sakazakii
cataatcagtacatgcttctgacttggagcatctccagtcaatcaggaagcctctataggcagtataaggtcttgtaaaattattaaggctcccgtaaagttcttgcgggagccttaataatttcatatatccgcaaaagggtttcagcac

SEQ ID NO: 17596 - RNA, 153 nt, Escherichia coli
  source 1..153: mol_type = other RNA; note = Related to NZ_ADJG01000004.1
catcatgtatgtatgcttctggcttggagtatctccagtcaaacagggagcctctacaggcagtatagttatgttaattacaaaggccctgagtgataaaaattactcagggcctttgtaatttctaacatacaaaataacagtggatgctga

SEQ ID NO: 17597 - RNA, 144 nt, Escherichia coli
  source 1..144: mol_type = other RNA; note = Related to ABBXOP010000094.1
gataatgaatccatactcttgactagtgagatatctccagtctaaaagagagtccctaaaggcagtatagttttaaattagaaaaggcggagagaaatctccgccttttctaatttaaaacagggagaggatgttttgaaaata

SEQ ID NO: 17598 - RNA, 145 nt, Proteus sp.
  source 1..145: mol_type = other RNA; note = Related to CP021694.1; note = Proteus mirabilis
tataatataaccatactcctgactagcgagttatctccagtcataaagggagtccctaaaggcagtataaatatattagaaagggtgaagagagattcttcaccctttctaatatatagggggaaagaatatgaaattagaggaa

SEQ ID NO: 17599 - RNA, 151 nt, unidentified
  source 1..151: mol_type = other RNA; note = Related to ALIV01000029.1; note = Pectobacterium atrosepticum
tattgtattcttatgtcgtctgactagtgggcattccccagtcacaatagacggcctctacaggcaattagttacgttacatgcccatcagcaaaaggtacaaaagcctacttgttgatgggctttgtaattttaatggctttgacattct

SEQ ID NO: 17600 - RNA, 161 nt, Enterobacter sp.
  source 1..161: mol_type = other RNA; note = Related to CP029126.1; note = Enterobacter hormaechei
taagatgatgttatgccgtctgactagtgggcattccccagtcatgatagacggcctctacaggcaattagtaacgttacaacccctcaatatagatggtgtcaataaaacaccggtaattgaggggttttgtaattatatccattaaaaagtttacgtat

SEQ ID NO: 17601 - RNA, 160 nt, Escherichia sp.
  source 1..160: mol_type = other RNA; note = Related to NZ_CP042942.1; note = Escherichia fergusonii
tataaattgatcatgtcgtctgactagcgagtattctccagtcacagtagacggcctctacaggctattaagtacgttactgcccccttagatcgttcttctctacgaagctactgtttaagggggctttgtatttctaattcactatacctgactgccc

SEQ ID NO: 17602 - RNA, 158 nt, unidentified
  source 1..158: mol_type = other RNA; note = Related to CP096258.1; note = Providencia rettgeri
tatactcattgcatgccgtgactagtgagaatctccggtcagcgaacggcctctacaggcattaagatatcttgcaataccgcttcataacttgtaattaattgaaaaattacacacttatgaggcggtttttgtatgtctatccaaccttaccctct

SEQ ID NO: 17603 - RNA, 165 nt, unidentified
  source 1..165: mol_type = other RNA; note = Related to NC_012880.1; note = Musicola paradisiaca
tatactaaatccatgccgtgactagtgagaatctccggtcaattgacaacggcctctacaggctttaatgcacttacaatgccgcttcgcttactcgtagttagttgaaaaacctacgatgtaacgaggcggtttttgtatgtatcataccagctacccatacat

SEQ ID NO: 17604 - RNA, 146 nt, unidentified
  source 1..146: mol_type = other RNA; note = Related to NZ_CPWN01000004.1; note = Yersinia frederiksenii
taaagtaatttcatgccaacagactaggagtatctccagtcaatagtgttggcctctacaggcaattattcaatgttgcacttgtgtattccccctcaatgggggatacacaagatgtaaagaggtataacttggcaaatctaaac

SEQ ID NO: 17605 - RNA, 145 nt, unidentified
  source 1..145: mol_type = other RNA; note = Related to PYNG01000071.1; note = Photobacterium kishitanii
taagattatacacagctagcgactaggagtagctccagtcacaataactagcatttatagattacttataaatttaatttacagttgcatgaagtctttaattaggcttcatgcagtatgtaatcttatccctttcccttccctt

SEQ ID NO: 17606 - RNA, 149 nt, unidentified
  source 1..149: mol_type = other RNA; note = Related to QGLM01000007.1; note = Frischella perrara
tattctacgaatatgccagtgactaggggtatctccagtcgataagctggcctctactggtccatcagatacatttactggtgcggtttaatttagtattaaccaagttataccgcatattgtaaatttctatatcaatttaacttatc

SEQ ID NO: 17607 - RNA, 147 nt, Aeromonas sp.
  source 1..147: mol_type = other RNA; note = Related to CP077210.1
taacgtctgcatcactggtgactaggagtaactccagtcgttaagccagtccctaggcgtcattacctgatttctttcttccccccctctttactatgctgagaggggaagggaagattgaaagtataaatacccttcagttttccc

SEQ ID NO: 17608 - RNA, 154 nt, Aeromonas sp.
  source 1..154: mol_type = other RNA; note = Related to JAEHHQ010000003.1; note = Aeromonas veronii
aacgttagctccactggtgactaggagtaactccagtcggtaagccagtccctaggggtcattacctgatttcattcctccctcccctcctgtttttcacattggcagagaggggaagggaagattgaaaataatcgcacatcgcacatcgcac

SEQ ID NO: 17609 - RNA, 160 nt, Aeromonas sp.
  source 1..160: mol_type = other RNA; note = Related to NZ_MVPS01000007.1; note = Aeromonas veronii
gataatttcgaaatactagtgactaggagtatctccggtcaatccaaaggatacgtccaatggataagctagtccctaggggtcattacctggtttcttttatctctcccctcatgaatgagggggggatatttgaaattatctatttatcttgcccctc

SEQ ID NO: 17610 - RNA, 134 nt, unidentified
  source 1..134: mol_type = other RNA; note = Related to SIHL01000004.1; note = Alteromonas sp.
tatacttaagttcaccagtgactaggagaagctccagtcacaaagctggtccctaggagtcattataaaatttcactgttacgcccctcttttggggcgttcagatgaaaattgcgacttgttttataaacatc

SEQ ID NO: 17611 - RNA, 135 nt, unidentified
  source 1..135: mol_type = other RNA; note = Related to NZ_CP074570.1; note = Paraneptunicella aestuarii
tataatggcggttaccagtgactaggagaagctccggtcggaaagctggtccctaggagccataatttgatttcgctgtccatcccttccaattgaggaagggggatagttgaaaagattgtgttttttctccac

SEQ ID NO: 17612 - RNA, 137 nt, unidentified
  source 1..137: mol_type = other RNA; note = Related to NMRX01000072.1; note = Methylococcaceae bacterium CS5
tataatacaaagaccggtgactaggagtatctccagtcgtaatgctggtcactacttgccttcagctatttcttctggtcactttgtctatgatagacagggtggtcgattgaagaattttctcctccctacctccc

SEQ ID NO: 17613 - RNA, 139 nt, unidentified
  source 1..139: mol_type = other RNA; note = Related to QNFQ01000482.1; note = Gammaproteobacteria bacterium
tataatcaaggctactggtgactaggagtatctccagtcgtaaagctggtccctatcggtctggatttaatttctctgtctgcccttcccaacacggggggcaggtagctgaaaagttctcatattgccaatatatccc

SEQ ID NO: 17614 - RNA, 134 nt, unidentified
  source 1..134: mol_type = other RNA; note = Related to NZ_JOKH01000004.1; note = Endozoicomonas numazuensis
tatacttgtttttaccagtgactaggagtagctccagtcgtaaagctggtccctagtggcctacatgtcatttcttctacgaccctcttcagagggtcagtggttgaaaactcttttactagcttttggttttt

SEQ ID NO: 17615 - RNA, 133 nt, unidentified
  source 1..133: mol_type = other RNA; note = Related to LT841305.1; note = Acidithiobacillus ferrivorans
tacactagctctaccagtgactaggagtatctccagtcgttgagctggtccctacctgcctttatgcaatttcttcaacctgctccctctgtgggtgcaggtagttgaaaatcccagccgaccagtggaatcg

SEQ ID NO: 17616 - RNA, 140 nt, unidentified
  source 1..140: mol_type = other RNA; note = Related to NVXL01000289.1; note = Alteromonadaceae bacterium
tacaatagacctactggcgactagaggtatcctcagtcacgaagccggtcactagaggtctttagttatttctctggctgctcccccagttttctgggtgagcaggtagttgaaaaagagccctccgcctaccgatctgt

SEQ ID NO: 17617 - RNA, 150 nt, unidentified
  source 1..150: mol_type = other RNA; note = Related to NZ_CP019628.1; note = Pseudoalteromonas aliena
tataatggaatgactggcgactcggagtatctccagtcaacatgctggtccctaaatgcctataggtatgtttcttctgttgcctttgtcaacgattcggttcggcaaaggcaactagttgaaataagtctctagagtctttcgccttgc

SEQ ID NO: 17618 - RNA, 130 nt, unidentified
  source 1..130: mol_type = other RNA; note = Related to JAFLKV010000025.1; note = Sulfuricurvum sp.
tataattgcttttatgattgagtgacttgaagtatcttcagtctaaatgcttaatcctctaaggtgctttatttactaatgcaagggcattatttgccctttgtaaaaggtgctcagtgactcaaacctc

SEQ ID NO: 17619 - RNA, 129 nt, unidentified
  source 1..129: mol_type = other RNA; note = Related to JAJPEU010000001.1; note = Sulfurovum sp.
tatacttataccatgattaagtgactagaggtatcctcggtcatattagcttaatcctctaaagtgcaatattactgtgactaagccctttaaagggcttatgtaaaggtaaaaatttgaataaaactt

SEQ ID NO: 17620 - RNA, 142 nt, unidentified
  source 1..142: mol_type = other RNA; note = Candidatus Thioglobus sp.; note = Related to FXLF01000023.1
taaaataactttaggctaaatgactagaagcaccttcagtcatataaactatttagcctctaagcggttattactaattttaaatgcctaattttgattcatcgaaattgggcattttaaaaaataccagccaatcaaatga

SEQ ID NO: 17621 - RNA, 156 nt, unidentified
  source 1..156: mol_type = other RNA; note = Candidatus Thiodubiliella endoseptemdiera; note = Related to JACCHT010000001.1
tataatataaccacgctaaatgactagaagtatcttcagtctaattcactccaaaggagaatttagcctctaagcggttattattaattttaaaatgcctggttttgattctatcaaaactgggcattttaaaaaatgccaactaatttataatgc

SEQ ID NO: 17622 - RNA, 149 nt, unidentified
  source 1..149: mol_type = other RNA; note = Related to VCHC01000138.1; note = Gammaproteobacteria bacterium
cactcacgctaaatgactagatgcatcatcagtcaatttaaaatttagcctctaagcggttatcattcatttttcacatcctcaatactttgattattttcaatcaaagcactggatgtgaaaaaacgctacctaatttatgacaaaaa

SEQ ID NO: 17623 - RNA, 213 nt, unidentified
  source 1..213: mol_type = other RNA; note = Related to NZ_AP024849.1; note = Clostridium sp.
tggagtttatccaaccttagcagttaaggtagttgaaagcacaaaatattgtaaaattattatcggctaccgccgataatatgagagtgaaaatttactattttgcgcagcaagaacagctggttctagctacaaaaatagtaaattttcggtgagttacaaagaataattttagtaggattcctcccaatagtaggtgaaatatgaagtatt

SEQ ID NO: 17624 - RNA, 213 nt, unidentified
  source 1..213: mol_type = other RNA; note = Related to JAHHUY010000039.1; note = Clostridium tyrobutyricum
ggcattcagccaaccttagaagttaaggtagttgtaaatacaaaattgtaaaattattatcggactaccgccgatatatatgagagtgaaaatttcatattttattaagatagaacaaactggttctatctacaaaaatatgaaattttacgatgatttactaataataattttagtaggattcctcttaaaggtgatgaataattatgcaat

SEQ ID NO: 17625 - RNA, 216 nt, unidentified
  source 1..216: mol_type = other RNA; note = Related to SWQT01000003.1; note = Clostridium botulinum
ggcacagaaatatgccaccttagctgttaaggtaatagaaagcacaaaatagaaaaattattatcggactaccgccgatgggatgagagtgaaaatttaatattttacgtagttataacatgctggttataacaacaaaaatataaaattttctatgatttatcaaggaataattttagtaggattcctcattaataggtaggtgtaatatgaaat

SEQ ID NO: 17626 - RNA, 206 nt, unidentified
  source 1..206: mol_type = other RNA; note = Related to UFXA01000002.1; note = Clostridium perfringens
tatacaaccttagcagttaaggtataagtagatacaattttcgtaaaattattatcggctaccaccgataggatgagagtgaaaattaaatattttaaatagctatcacaagctagttctagctataaaagatttaattttctagtgatttataaagaataattttagtaagattcctctaattataggtaggtgcaatatgaaat

SEQ ID NO: 17627 - RNA, 196 nt, unidentified
  source 1..196: mol_type = other RNA; note = Related to CP014223.1; note = Anaerotignum propionicum
ggctctatgccacctcagcattctgaggttaatgaaatcacaatcttgaaaaatttgaatttgatgcctcaaatatttgagaatttaatttatcggccagaacgacttgttctggaccttacaaaatcaaattcttttgtgactaactttaacaaatttttgtgggacactttttatggaggatgtataatggaat

SEQ ID NO: 17628 - RNA, 218 nt, unidentified
  source 1..218: mol_type = other RNA; note = Related to JAASHB010000001.1; note = Paeniclostridium sordellii
gacattttgtcgccttagcactctaaggataatgaaattacaattttgtaaaatttgaattgactctgtcaatatttttgaaagttaaattattaaaaatttatgttacaatcatctagaattgataacagaaatttttaataattaattgatctatttattataacttaatcaaattttagtagggtttcttttttatggaggaaataaattgaaat

SEQ ID NO: 17629 - RNA, 210 nt, unidentified
  source 1..210: mol_type = other RNA; note = Related to AAXVUS010000010.1; note = Clostridioides difficile
gacacattgtcaccttagcattctaaggttagtgaaactacaaaattgtaaaatttgaattgactcagtcaatatttttgaaagttgattctttaaaattagcaaactcaactagctagattgagattcgccaattttaaagaatctaaaagcttaattttatcaaattttagtggggtttctttttttgggaggaaatatgattaaata

SEQ ID NO: 17630 - RNA, 209 nt, unidentified
  source 1..209: mol_type = other RNA; note = Related to NZ_FMMP01000006.1; note = Cellulosilyticum sp.
gactatatgtcaccttaacattttaaggtaatagtaataacaaaagaatgctcaatttgtatttgctacgcgcataattttgacgataaattatttcaatttcttcactcttgtacttacaaggagcaaagaaatcaaaacaatttacaaaacaaatatttcaaatttcagtagggttcctttttcttaggaggataaatgaatataca

SEQ ID NO: 17631 - RNA, 219 nt, unidentified
  source 1..219: mol_type = other RNA; note = Related to NZ_JACOOV010000022.1; note = Blautia sp.
gacttatttgtcaccttagcttttaaggttaatataattacaaaatagtaaaatttgaattgattccatcaatgattttgagtggataagaaaaattttaaattgctcactatctgggttcaaattgaaaatttttcttattagatcaatttgtcaaataaaatatatcaaattttagtaggatttcccttgattttatgagggaaaaatgtataggtt

SEQ ID NO: 17632 - RNA, 226 nt, unidentified
  source 1..226: mol_type = other RNA; note = Related to CP042243.1; note = Crassaminicella thermophila
ggctatttgccaccttagcttttaaggttaaagcaatgacaatttgttaaatttgaattgactccgtcaatatttttgatgatgtaattaaatttattgcacaaccgttttggctcactgactcagctcgccaaaagaacgcacaataaatttaattacatgtcaataaatttaatcaaatttaagtagggtttctttttttagttgggaagtgataaattggata

SEQ ID NO: 17633 - RNA, 227 nt, unidentified
  source 1..227: mol_type = other RNA; note = Related to NZ_QUEQ01000010.1; note = Ruminococcus sp.
agcctttggcttcctcagcgtttgaggataaagtagttaaaatttggttaaatttgttcgactacgtcgatgttttgagacaagtcaatttattctaagaacctatcaacgtcggcaaacttgccgccattgatagaacctcagaataaatcaacttgtatacaaataattgttaccaaatttaagtaggatcctttttttgtggagaaaagatgaaacaatacatt

SEQ ID NO: 17634 - RNA, 226 nt, unidentified
  source 1..226: mol_type = other RNA; note = Related to FMEB01000016.1; note = Roseburia sp.
agctttttgctccctcagcgtttgaggataaggtaattaaaatttggttaaatttgttcgactgcgtcgatgttttgtgacaagtcaatttattctgagaacctacgaatgtcggcaagcttgccgccattagtagaaccccagaataaatcaacttggttacaaagaactgttaccaaatttaagtaggatccttttttgtggagaaaaaatgaaacgatatatt

SEQ ID NO: 17635 - RNA, 227 nt, unidentified
  source 1..227: mol_type = other RNA; note = Related to JAGZZD010000009.1; note = Roseburia sp.
ggctttttgccacctcagcgtttgaggttaaagcaatataaatttggttaaatttggtcgacgatgtcgatgtttggtttaaaagtaaatttattatatgaaccttcttatttcggcaaccttgcctcaataagaagaaccccataataaattttctttttgcaaagaattatttccaaatttaagtaggatcctttttttatggagaaaaaatgaaacgatacata

SEQ ID NO: 17636 - RNA, 251 nt, unidentified
  source 1..251: mol_type = other RNA; note = Related to JAFQBJ010000029.1; note = Agathobacter sp.
ggcttttgtgccgcctcagcgtatgaggttaaagcaatgagatttggttaaatttggcttgacagacgtcaaatctttggagtaaaagatttgaatttgctgagaacccacgtctacagccacgcttggctgttgacgtagaacctcaccaaattcaaacttttaggcaataaattcttaccaaatttaagtagggtccttttttgttacatttttttaagaaaagagtacggaagatgaaaaaatatatt

SEQ ID NO: 17637 - RNA, 225 nt, unidentified
  source 1..225: mol_type = other RNA; note = Related to NZ_MJHW01000008.1; note = Roseburia sp.
ggcataaatgccaccttaacattttaaggtagatgtatttagaaattagttaaatttgtatgactaccgtcatatttcagatttcaatttcattggttgttcacaaccatgaccttcgctactacgctcaggtcagaacgcaaacaaccaatgaaattgactcagaaaaaatttaacaaatttaagtaggattcctttttttatggagaaaactatgtataaatt

SEQ ID NO: 17638 - RNA, 226 nt, unidentified
  source 1..226: mol_type = other RNA; note = Related to NZ_JADMQW010000015.1; note = Intestinimonas butyriciproducens
ggcatactgccgccttagctattaaggttgatgtaactacattctgttgaatttggaatggcttccagccatgctgtgtagccagaaagaaagtaaaatcagaacctcggccctcgcgaacttcgctcacgccgagaacccgctttcactttcttcctgttcaaagaattgtaccaaattcaagtggagttctttatttataacagacgggggtatagcatgctta

SEQ ID NO: 17639 - RNA, 227 nt, unidentified
  source 1..227: mol_type = other RNA; note = Related to RKGG01000020.1; note = Clostridiales bacterium
ggttaataaccgccttagcttttaaggttaatgtaactacaaaatgttgaatttaaaatgaccttcggtcatatttatattcaaacaaaaacatatcatcaacaacctgacattcgcgaacttcgctcatgttcagaacgccgctgatatgttttcatttgttcaaagaatttataataaattcaagtggagtcctccactgttttcaatggtggtgaatataagtt

SEQ ID NO: 17640 - RNA, 222 nt, unidentified
  source 1..222: mol_type = other RNA; note = Related to DNFS01000014.1; note = Ruminococcus sp.
ggcattactgccaccttagctattaaggttaatgtaactacatttcgttgaatttggatgacatcctgtcatctttagttaaggaagaaaatagcatcaccaaccgcttggtcgcgggactccgctcccggcgagaacgctgatactattttccaccttttcaatgaattgtaccaaattcaagtggggttctttttatttggggttaaatagttatgatat

SEQ ID NO: 17641 - RNA, 226 nt, unidentified
  source 1..226: mol_type = other RNA; note = Related to JAGAMN010000013.1; note = Oscillospiraceae bacterium
ggcgttatgccgccttagcagttaaggttgacgtatcataaatgagttgaatttggatggctgtccagccatgctgtattataagcaataaaacagcatcaacaaccatcgggctccgcggctccgctccgcccgagaacgccgctgctgttttattccttttcaataaattctaacaaattcaagtggagtcctttttctacgatcaggagggtgacgttgtgta

SEQ ID NO: 17642 - RNA, 223 nt, unidentified
  source 1..223: mol_type = other RNA; note = Related to FMXS01000006.1; note = Ruminococcaceae bacterium FB2012
ggtattttatgccgccttagcttttaaggttaacgcatctacaatttgttgaatttggatgacgtcccgtcatattttgatgggacagaaaagaaaagagaaaacctcaccgctcgcgagctacgctcacggtgagaactcctcttttctttcagtcctgcaatgaattgtaccaaattcaagtggagttctttttattttgaggtggaatatccaatgagaa

SEQ ID NO: 17643 - RNA, 225 nt, unidentified
  source 1..225: mol_type = other RNA; note = Related to QPZU01000011.1; note = Clostridium botulinum
ggtgtaaagccacctcagcatttgaggttaagaatttacaatttgttaaattttgaatgactccagtcatttttctgatagatttgaattattataggcacaaccttttataagctaagcttagctcataaaagaacgcaccaataataatacaaatctacaataaattgtatcaaaatctaagtaggattctttttttattttggaggataatatgcaagaata

SEQ ID NO: 17644 - RNA, 254 nt, Bacillus sp.
  source 1..254: mol_type = other RNA; note = Related to LJIT01000071.1; note = Bacillus cereus
ggctcaagtgccaccttagctgataaggtagttgtatctacaattagttgtgttaagacaactaatcgttaagtttttattgactgccgtcaataactttgtttacaatgctaagtatttattataaccatgtaaattcgctacttcgctcattcacagaacataataaatacttagattgttacaaacaattaattaaaaatttaagtaggattccctcctatttttttaatgtaggtgatattggatgaaaa

SEQ ID NO: 17645 - RNA, 242 nt, Bacillus sp.
  source 1..242: mol_type = other RNA; note = Related to NVJL01000019.1; note = Bacillus toyonensis
agcgtaaatgctgccttagctgttaaggttgttttaattacaatttgctccattgttaaattttccattgactaccgtcaattgtttggagctacaattctaattatttattataaccgtgcgaattcgctactacgctcattcacagaacataataaaaaattagattgtatcaaataatttttcgaaaatttaagtaagattccctttttatttctaaaataggtggtatgtgatgaata

SEQ ID NO: 17646 - RNA, 235 nt, unidentified
  source 1..235: mol_type = other RNA; note = Related to NZ_JAIVKS010000001.1; note = Priestia aryabhattai
agcgtatttgctgccttagctgttaaggttgttgtagttacaataaagatcggttaaatttttattgactgccgtcaatatttttgttggcaatatatttatttattataaccgtgtggattcgctacttcgcttatccacagaacataataaagaaatatatcgcttcaaacaattatttgaaaatttaagtaggattccctttatttttgaaataggtgatgttatatgaaag

SEQ ID NO: 17647 - RNA, 229 nt, unidentified
  source 1..229: mol_type = other RNA; note = Related to NZ_VEEP01000002.1; note = Cytobacillus oceanisediminis
agcttaggctgccttagctgctaaggttagtgtaatttaatttagttaaatttttattgactaccgtcaattcttttggtctgcaaacatatttctttattataaccatgggaattcgcaactcagctcattcccagaacataataaagaaatattttgctccaaataaatatttaaaaatttaagtaggattccttttcttttttaaaaaaggtgataatgatgaaaa

SEQ ID NO: 17648 - RNA, 234 nt, Bacillus sp.
  source 1..234: mol_type = other RNA; note = Related to LR134328.1
aacttttttaaagttgccttagcgtctaaggttacagcaataacaaaatgttaaatttccattgactatcgtcaatattgtgtagttttttattttaattctttacaaccgtgtgactacgcaaatctttgctccgtcacagaacgtaaataattaaaataaaaagtcaatgaattttttaggaaatttaagtagggctcctcctaatgattaaaggagagataaaagagtggg

SEQ ID NO: 17649 - RNA, 225 nt, Bacillus sp.
  source 1..225: mol_type = other RNA; note = Related to NUQK01000037.1; note = Bacillus wiedmannii
agcttttagctaccttagcgtttaaggttaatgcattgagaaaatgttaaattttcaagacttgcgtcttaattgtgagaaatgcattttcattttccataaccatgagcctacgcaaatctttgctccggctcagaacatgaaaaaggaaaaagcatatgcaataaatttattggaaaatttaagtagggctctttttatcgttggaggttaaagacttgaata

SEQ ID NO: 17650 - RNA, 233 nt, Bacillus sp.
  source 1..233: mol_type = other RNA; note = Related to NUNG01000033.1; note = Bacillus thuringiensis
tacctttttaggtaaccttaaaggttaaggttaaagtagctagattaggaaaaaaatgatgaacgacgccgttcattgttttcgaggatactttcgattattccggcctcccttgcagaagcaatctttgcttccactgcggtcaaccgaactaatcgaaagtatgtccaataaaatcattttcatttttttgtagggcttttttttcatttggaggtattatataatgagtt

SEQ ID NO: 17651 - RNA, 232 nt, Bacillus sp.
  source 1..232: mol_type = other RNA; note = Related to NZ_CP085511.1; note = Bacillus cereus
tacctttttaggtaaccttaaaggttaaggttaaagtagttagattaggaaaaaaatgatgaacgacgccgttcattgttttcgatgatgctgtcgattattccggcctcccttgcagaagcaatctttgcttccacttcggtcaaccgaaataatcgaaagcatgtccaataaaatcattttcatttttttgtagggctttttttcaattggaggtattatataatgagtt

SEQ ID NO: 17652 - RNA, 228 nt, unidentified
  source 1..228: mol_type = other RNA; note = Related to QXJM01000039.1; note = Cohnella faecalis
taccgttaaggtaaccttaaagtttaaggtaaatgtatctagaattgaaaaaaatgaggagctcgcgctcactgttttcgaggatactatcaattagtccggtctccattgcagaagcaatctttgcttccgctgcagtcaaccggcctaatcgacagtattgtcaataaaatcattctcattttttgtagggcttttttttatccttggaggtatctataatgagtt

SEQ ID NO: 17653 - RNA, 227 nt, Bacillus sp.
  source 1..227: mol_type = other RNA; note = Related to NZ_AEHM01000023.1; note = Bacillus subtilis
taccgttatggtaaccttaaagtttaaggttaaagtatttagatttaagaaaaaatgaggaacgaggccgttcattgttttctgggatacttccgattattccgtccggcctagcagaagcaaactttgcttccgcgtcgtccagccgaactaatcaaaagtattttcaaataaatcattatcattttttgtagggcttttcctattggaggattacatgaagtttt

SEQ ID NO: 17654 - RNA, 232 nt, unidentified
  source 1..232: mol_type = other RNA; note = Related to JAFHKR010000035.1; note = Fictibacillus nanhaiensis
catgtacacagttaccttagcgtctaaggttgagacaatcacaaaatgtaaaaatattcagaacttgcgttcattgttttacaagaatgcaattaattttataacaaccgctcgcttacgcaatctttgctccagctcggaacgctataaaattaataacatttacaatgaaattcatgaatatttttagtagggctctttttatttattttgggggtaaatttattgtatg

SEQ ID NO: 17655 - RNA, 229 nt, Bacillus sp.
  source 1..229: mol_type = other RNA; note = Related to FMJM01000007.1; note = Bacillus cereus
aacagttaccttagcggttaaggttttgataactacaaaatgaaaaaatgttctgaacttgcgttcaatgttttacaagaatgcttttaatttttataacaaccgctcgcttccgcaatctttgctccagctcggaacgttataaaaattaaagagcatttacaataaaattcatgaacatttttagtaggactctttttattttttgggggttatgttgcaatggata

SEQ ID NO: 17656 - RNA, 232 nt, unidentified
  source 1..232: mol_type = other RNA; note = Related to JAJJZD010000002.1; note = Thalassospira sp.
atcttttggtgatgccttatagtataaggttggattcctaagaattaggaaaaaatgaggaacgtgggagttcagtagtttgagcgcaccgcgtttataaataagtgtcgctcgaattcgcaatctttgctcattcgttcgcttacacttatttataatcttgtgaacaataaaattttactcattttttgtagagctttatttactataattaaggagattcaaatggata

SEQ ID NO: 17657 - RNA, 238 nt, unidentified
  source 1..238: mol_type = other RNA; note = Related to NZ_VEEI01000002.1; note = Lysinibacillus fusiformis
tttaagaccttagctgttaaggttaatacatctagaaaatgtaatattgttcggcacgttacgtgcctgatttgcttggtaaacttttaatttttaaagaaccgcacgttttcgcaagctatgctcaaacgaggaacctttaaaaactaaaagtactccaataaaattcaagaacaatattacaaaatatttattttgtagggctcttcttatctgtggaggagaattatgattaata

SEQ ID NO: 17658 - RNA, 263 nt, Streptococcus sp.
  source 1..263: mol_type = other RNA; note = Related to FR873482.1; note = Streptococcus salivarius
aacatatcatgttatttcctttggtagttccaaaggttgagtattttaaaaatagtaaaatttgatactcgactttgtcgaggatagtaataaattactatataaaatagaattacgaaaggtagtacgtagaacctttagacatacggcgaactcgccgcaagtcgtcaagaacccacgtactacctttcgttctcaatgaaagtctctacaaattttaggtagggctctttttatatggagcaatgatgagtaaatatata

SEQ ID NO: 17659 - RNA, 241 nt, Streptococcus sp.
  source 1..241: mol_type = other RNA; note = Related to NZ_VMMH01000009.1
aacatatcttgttatttcctttggtagttccaaaggttgagtattttaaaaatagtaaaatttgttactcgactttgtcgagaatagatagttcaattacgaaacgtcgcacctagaacctctagactcacggcgaactcgccgtaagtcgtcgagaacctacgttctccatttcgtaacaagtaaagcttctacaaattttagtagggctctttttatgtggagtgtttatggaaaagta

SEQ ID NO: 17660 - RNA, 174 nt, unidentified
  source 1..174: mol_type = other RNA; note = Related to NC_022549.1; note = Paracholeplasma sp.
gagccctagtaattagatgctggaatcggcaccttggtttgtgtagatcaaactttgcgaattacgttagtaacacggcgtgcgaactattaaaactgtcattcttaaaactgcagacagtttcaagaatgccaatttcaacatttcgcactaactttttaagtagggctctcc

SEQ ID NO: 17661 - RNA, 165 nt, unidentified
  source 1..165: mol_type = other RNA; note = Related to VOWY01000007.1; note = Collinsella sp.
taaggtcgcagcgatatctattaccgtcatattgaggtgtccgccgttaaggatggactagagatatcatttaccctttcgtgcttggacgatttccgttctctcgtccttcaccggggggttcaggacgagagaacggaaatcgcccaaacagtgcggccttat

SEQ ID NO: 17662 - RNA, 165 nt, unidentified
  source 1..165: mol_type = other RNA; note = Related to QSBV01000001.1; note = Collinsella sp.
caaggccgcagctagtcattgattgccccgattggagcgagtcctctgttaaagatggactgagacgtttttaccaattttggtccgtgcatatggtcattccatagccacggacccgaatccgtgtctacggaatgaccatatgcacggactgtgcggccttgt

SEQ ID NO: 17663 - RNA, 157 nt, unidentified
  source 1..157: mol_type = other RNA; note = Firmicutes bacterium; note = Related to JABLXJ010000013.1
gagggcactagttttagggtcattttgcatagggcgtggccgtgtgccgggcgttaagccaggccgttgaattgatagacttgtggccgcgcggaagtccctcgtctaccctctcgggtagccaaggtccttccgcgcggctcttgtagtgccctcg

SEQ ID NO: 17664 - RNA, 158 nt, unidentified
  source 1..158: mol_type = other RNA; note = Lachnospiraceae bacterium; note = Related to SVEQ01000005.1
agggattctagttttaatataagagttttgctctttttctctgagttgagttcagagaaagttttattgttggtattcgggcgagatttatcactcgcaagaataccagtattcttgcaagcaataaatctcgcttgcgctttaatgtagaatccctt

SEQ ID NO: 17665 - RNA, 162 nt, unidentified
  source 1..162: mol_type = other RNA; note = Related to QVFD01000002.1; note = Coprococcus catus
agagattctagtattaatctaaaggcctatggcctttggttctctgagttgagttcagagaatgaaagattgctgacattcgtggcgagttaaaggactcgaaccgatgccagcattggttcgagtcctttaactcgcttccggtttaatgtagagtctctt

SEQ ID NO: 17666 - RNA, 165 nt, unidentified
  source 1..165: mol_type = other RNA; note = Clostridia bacterium; note = Related to JAFTQC010000025.1
agagattctagttttaatctataaagcaatttgcgtttatagtccttagagttgagttcagaggatggaaaattgtaagtcaatcgtgcaaagtttaatcaaatatggctcgcacacgacccatatccgcttaaactttgcctgcggcttaatgtagaatctctc

SEQ ID NO: 17667 - RNA, 175 nt, unidentified
  source 1..175: mol_type = other RNA; note = Related to JACSRA010000017.1; note = Clostridium sp.
gagaattctagatttaatcgataatatagtagtattatctatatattatcttctctgagtagatgtgcagagaaagttttgtttttgtccattcttgtaataaaattacaagagatttattccagaataaatcacttgaaatcttattacaatgaggattaatgtagagttctct

SEQ ID NO: 17668 - RNA, 153 nt, unidentified
  source 1..153: mol_type = other RNA; note = Related to NZ_CP022106.1; note = Halobacillus halophilus
agggtttctggggatttatgtcacttatactaacatatttgccttgtgtaagcagggttggcagaattgtgtggcttggcttgcatatagtttcactcgcagctcttgctcagagctactcgtaaaactatatgcagcatagcagaaaccctt

SEQ ID NO: 17669 - RNA, 155 nt, unidentified
  source 1..155: mol_type = other RNA; note = Clostridia bacterium; note = Related to JAFRUO010000020.1
agaatacttagtgaaaatatatcacagtaatgtgttatagtgccttatgtaaaatagggtcggtttctttggggctcttacaagcagttgctacacaacgcttgtaatcctcattacaagcgttgcgtaccaactgcttttatgtaagtattctt

SEQ ID NO: 17670 - RNA, 141 nt, unidentified
  source 1..141: mol_type = other RNA; note = Clostridia bacterium; note = Related to JAGBXM010000051.1
ttttatatatcacttttttatgtgttatagtgccttatgttaaatagggtcagttattttggggcgattacaagctgttgctattaacggcttgtaatctcttacatgccgttaatatcagcagcttttgtaagtgttctc

SEQ ID NO: 17671 - RNA, 155 nt, unidentified
  source 1..155: mol_type = other RNA; note = Related to JAGAZX010000174.1; note = Oscillospiraceae bacterium
agaatgcttagaaattttatatcacagaaatgtgttatagtgccttatgttaattagggtctgttactttggggctcttacaagcagttgctgcgccacgcttgtaatccccattacaagcgcagcgcatcaactgcttcatggtaagtgttctc

SEQ ID NO: 17672 - RNA, 155 nt, unidentified
  source 1..155: mol_type = other RNA; note = Related to JAFRDB010000067.1; note = Clostridia bacterium
aaagtacttagtaagatatatcacaaaatgtgtatatagtgccttgtgttaaatagggtcagatgaattggggcgattacaagccgttgctacaaactgcttgtaatcctcattacaagcagtttgcatcaacggcttagtgtgtaagtacttta

SEQ ID NO: 17673 - RNA, 155 nt, unidentified
  source 1..155: mol_type = other RNA; note = Clostridia bacterium; note = Related to JAFTXX010000014.1
agaatgcttagtatttttatatcacagaaatgtggtcataagtgccttatgttaaatagggtcggatcttttggggctcttacaagcagttgctgcgcacgcttgtaatcctcattacaagcgcacgcatcaactgcttagcggtaagtgttctc

SEQ ID NO: 17674 - RNA, 156 nt, unidentified
  source 1..156: mol_type = other RNA; note = Related to FMGM01000006.1; note = Clostridium sp.
gaaatacttagtaaattatatggcttagaaagtcgtattgtgctttgtgttaaacagagccagaagaattgtgaggattacaagcagttgctgcgtcacgcttgtaatttctcattacaagcgcgccgcagcaactgcttagttgtaagtatttcc

SEQ ID NO: 17675 - RNA, 156 nt, unidentified
  source 1..156: mol_type = other RNA; note = Related to QUIJ01000008.1; note = Butyricicoccus sp.
ggaatgcttagtaaaaagaatatggcgtttttgtcgtattgtgccttgtgttaaatagggccagttagattgtcaggattacaagcagttgctgtggcacgcttgtaatcctcattaaaagcgtaccacagcaactgcttatctgtaagtattcca

SEQ ID NO: 17676 - RNA, 156 nt, unidentified
  source 1..156: mol_type = other RNA; note = Related to NZ_PDCG01000001.1; note = Bifidobacterium aemilianum
tgagcacctagttttttgggtaattggttcgtgaattcaattacctctatgcgtaagcatggacgaaagattgctggtcctttgagtgatgtttgtcctcaacggaacgagcggtcgactccggtgatgacaaacatcactcaagtaggtgctcac

SEQ ID NO: 17677 - RNA, 185 nt, Aeromonas sp.
  source 1..185: mol_type = other RNA; note = Related to NZ_JAACNB010000003.1; note = Aeromonas veronii
catgatattcttaaaaagatctctacatcgatagcttagaggaaccctgcttgcaaggttgatattatcatatcctagcctcctcatcggctaatctgtggcgtctcggcgcgtggcacttttagtgcacgacaagttcgtgaaaagatgaattagtatcaatataggatcaagatgaaaaagta

SEQ ID NO: 17678 - RNA, 185 nt, Aeromonas sp.
  source 1..185: mol_type = other RNA; note = Related to JADPIC010000001.1; note = Aeromonas dhakensis
tatgatattcttaaaaagatctctacatcgatagcttagagggaccttgcttgcaaggtcgatatcattatatcctagcctccacatcggctaatctgtggcgtctcggcgcgttgcacttttattgcacgacaagttcgtgaaaagatgaattagtatcaatatgggatcaagatgaaaaagta

SEQ ID NO: 17679 - RNA, 186 nt, Aeromonas hydrophila
  source 1..186: mol_type = other RNA; note = Related to NZ_AP023398.1
catgatatccttaagaagatttctatatcgatagcttagaggggtcttgttcgcaagattgatattactatatcctagcctcaacattagctaacttgtggcgcatccgccatgatgcacttttagtgcacgacaagttcgtgaaaagatgaattagtatcaatataggatcagaatgaaaagcta

SEQ ID NO: 17680 - RNA, 187 nt, Vibrio sp.
  source 1..187: mol_type = other RNA; note = Related to SZQJ01000005.1
agtgatatacttaggaagatttcttcatcgatagtatagagaggctttgttcgcaaagcagatgctttatgtatcccagtctcaacattgtctaatcccgcgcatccaggttgtgatgtacttttactgcacgacaagttcgtgaaaagatgaattagtatctatgtggaatctgtatgaaaaatta

SEQ ID NO: 17681 - RNA, 186 nt, unidentified
  source 1..186: mol_type = other RNA; note = Related to MUEZ01000005.1; note = Salinivibrio sp.
gatgatatactggaaaagatttcagaatcgatagtttagagagtgtttgttcgcaaattcgatatttttatatcctagtctcaatattgtctaaatggtgtgcacctttcaaatgtgtacttttaatacacgacaagttcgtgaaaagatgaattagtatctatatggaatcaaaatgaaaagtta

SEQ ID NO: 17682 - RNA, 186 nt, Vibrio sp.
  source 1..186: mol_type = other RNA; note = Related to NZ_LAUM01000014.1
gatgatatacttaagaagatttcagtatcgatagtttagagagtttttgctcgcaaattcgatatttttatatcctagtctcaacattgtctgactctgtgcatccctgtgtaggtgtacttttaatgcacgacaagttcgtgaaaagatgaattagtatccatgtggaatcataatgaaaaatta

SEQ ID NO: 17683 - RNA, 186 nt, unidentified
  source 1..186: mol_type = other RNA; note = Related to MSCJ01000001.1; note = Photobacterium angustum
catgatatacttaagacgatttcagattcgatagattagagaagcagtgcttgcaatgctgatatctttatatcctagtctcaacattgtcttaatctgtgcatccctcgcagatgtacttttaatgcacgacaagttcgtgaaaagatgaattagtatcaattatggaatcaaaatgaaaaatta

SEQ ID NO: 17684 - RNA, 186 nt, Vibrio sp.
  source 1..186: mol_type = other RNA; note = Related to ABBKDM010000016.1; note = Vibrio vulnificus
tatagtacaatcaaggaggtatcttcttcgatagactaatggggttccgttcgcgggatgaagcctggagcttcctagcctagtatgtgctagttctgtgcaactgtgctactagttgtacttttgaggcacgtaaacgtgaaaagacgttctttgtatccaagaagagattactatgaaaaaata

SEQ ID NO: 17685 - RNA, 186 nt, Vibrio sp.
  source 1..186: mol_type = other RNA; note = Related to AIDA02000097.1; note = Vibrio cyclitrophicus
tatagtacaatagaagagatttcatcttcgatagaataatggatctcgcttgcgagatggagcctggagctccctagcctaatatgtgcttgttctgtgcatccgtatcactagtggtacttttaaggcacgtaaacgtgaaaagacgttctttgtatcgtaagaagagattgttatgaaaaagta

SEQ ID NO: 17686 - RNA, 185 nt, Vibrio sp.
  source 1..185: mol_type = other RNA; note = Related to CP071059.1; note = Vibrio alginolyticus
tatagtacaatagaagaagtttcttcttcgatagactaatgggtctcgcttgcgagatgaagcctggagcttcctagcctaatatgtgcttgtcctgcgcatccgtatcgctaatggtacttttaaggcacgtaaacgtgaaaagacgttctttgtatccaagaagagattattatgaaaaaata

SEQ ID NO: 17687 - RNA, 193 nt, Pseudomonas sp.
  source 1..193: mol_type = other RNA; note = Related to NZ_JABUYN010000001.1
tacagtataatatcagaaatttcttcttcgatagattaagggaatttgctgatagtttatagtaaatgaagcctagtgcttcctagtcccattatgtgctagtagtccatccgtattcctggagctacttttaatgcacgtaaacgtgaaaagacgttcttggtatcttagaagagattgcaatgaaaaaaat

SEQ ID NO: 17688 - RNA, 186 nt, unidentified
  source 1..186: mol_type = other RNA; note = Related to NZ_CP012737.1; note = Pseudoalteromonas sp.
tcccgtatcattgaagatgtttcttcttcgatagattaggggattctacatttagaataaagcctagtgctttctagctcctttatttacttgcttggcgccttgtatctcctgttgccgcttttaaagcacgtaaacgtgaaaagatgttctttgtgtcatggaagaaatagaaatgaaaaagat

SEQ ID NO: 17689 - RNA, 183 nt, unidentified
  source 1..183: mol_type = other RNA; note = Related to NZ_CP046329.1; note = Shewanella putrefaciens
tttggtatcataacaacgatttcttcatcgatagagtaaagggttttgcttgcagaacggagccttgagcttcctagcctatcatttacttgttgctgctacagttcgtatcgcacttttaagtacacgtaaacgtgaaaagatgttctttgtatcgtgaaaggaatcattaatgaaaaaata

SEQ ID NO: 17690 - RNA, 189 nt, unidentified
  source 1..189: mol_type = other RNA; note = Related to NZ_PKFV01000007.1; note = Lelliottia sp.
aatggtataataaatgagatttcttcgtcgatagattaaggggccttgcttgttaaggtgaagtcatgaacttcctagccctgtctctactagctcggcatcctggggttaccagtagcgcttttgaggcacgtaaacgtgaaaagacgttcattgtatcaacgcagagatcttttttatgctcaaatt

SEQ ID NO: 17691 - RNA, 183 nt, unidentified
  source 1..183: mol_type = other RNA; note = Related to MAJY01000007.1; note = Aliivibrio fischeri
tatgatattatctcccacgtttcgaattcgatagaataagggggcttgtttcgacaagcgagcgctggacgctcctagctctaatattagctagttaagattaatttggcttaatgagtgtacttttaaggcacgaacgtgaaaagatgttcaaagtatcgagattgaaacaatgaataaaaa

SEQ ID NO: 17692 - RNA, 189 nt, unidentified
  source 1..189: mol_type = other RNA; note = Related to JAKGAW010000004.1; note = Pseudoalteromonas sp.
tctgatattataaataaagtttccgcttcgatagagtagggacttatgctactacaggtaagtgattgcttgtcattcctagcccattaatggttaatcaaggctacttgtcgactaggcagccttttagcccacaaagtgaaaagatgttcttgtatcaaagcggaaacaataacttatggacaaaat

SEQ ID NO: 17693 - RNA, 190 nt, unidentified
  source 1..190: mol_type = other RNA; note = Related to BPFA01000013.1; note = Shewanella sp.
tatgatatagtacaaaaattctaaagcgatagatttatggggctttgatactaaagttaacgctagccgttattaacccagtggtcactaattacgataaattggtcgcaatgatgacctttcatcagcacgcaaagcgtgaaaggatgttctaggtatcgtatttggaattttaattcatgaaaataat

SEQ ID NO: 17694 - RNA, 216 nt, unidentified
  source 1..216: mol_type = other RNA; note = Related to NZ_AKXJ01000001.1; note = Pseudoalteromonas sp.
tccgatattattaaaaaggtttcttcctcgatagctcaggagggcttgtacgcaagtcgcaatgggtagagtcgaaatactttaaacagagctcagctcctaacagtcactagatgtgcgaggttatcatcatactttaatggtcgctttaagtgcacacagcgtgtaaagattgttcttttgtgtcaaggaagaaaccctaatcatgaaatataa

SEQ ID NO: 17695 - RNA, 218 nt, Vibrio sp.
  source 1..218: mol_type = other RNA; note = Related to BA000037.2; note = Vibrio vulnificus
ttcgatattattaggaaggtttcttcctcgacagctcaggagggcttgcactcaagtcgcaatgggtagagtcgaaatactttaaacaaagcttagctcctaacagtcagtagctgtgcgcagttagcatcatactttaatgttaactttaagggcacacggcgtgtaaagattgttcttttgtgtcggggaagaagccgagatattatgaaatataa

SEQ ID NO: 17696 - RNA, 218 nt, Vibrio sp.
  source 1..218: mol_type = other RNA; note = Related to JAKEUX010000001.1; note = Vibrio brasiliensis
ttcgatattatcaggaaggtttcttcctcgatagccaaggaggacttgtacgcaagtcgcaatgggtagagtcgaaaggctttaaacaaagcttagctcctaattgtcagtagcagtgtgcggtttccatcatgctttaatggtaactttaagtgcacacggcgtgtaaagattgatcttttgtgtcgaggaagaaacctagatcttatgaagtacaa

SEQ ID NO: 17697 - RNA, 218 nt, Vibrio parahaemolyticus
  source 1..218: mol_type = other RNA; note = Related to JABCDA010000001.1
tccgatatcatacggaaggtttcttcctcgatagctcaggagggcttgtccgcaggtcgcaatgggtaaagcccacaaggctttaaacaaagcttagctcctaacattcagtagctgtgtaaggttgccatcatactttaatgggaactttaaatgcacacggcgtgtaaagattggtcttttgtgtcgaggaagaaaccaaaactcatgaaatataa

SEQ ID NO: 17698 - RNA, 217 nt, Vibrio sp.
  source 1..217: mol_type = other RNA; note = Related to NZ_PIFZ01000001.1; note = Vibrio splendidus
tctgatattatcaggaaggtttcttcctcgatagcgcaggaggacttgcacgcaagtcgcaatgggtaaagttggaaaactttaaacaaagcttagctcctaacagtcagtagctgtgcgccgtttccattatgctttaatggtaactttaaggcacacggcgtgtaaagattggtattttgtgtcgaggaagaaaccgttatattatgaaatatag

SEQ ID NO: 17699 - RNA, 209 nt, Vibrio sp.
  source 1..209: mol_type = other RNA; note = Related to CP087877.1; note = Vibrio alginolyticus
tcggatatccttaagaaggtttcttcctcgatagctttgagggacttacatgtaagttgatacgggtagggtttttggctctaaactatcttaacctcaacattgactagctgagcttgtccaagtgtactttaatgtaaactttaaggctcacggcgtgtaaagattgaactttgtgtcgtggaagaaaccattacaatgaaaaacag

SEQ ID NO: 17700 - RNA, 201 nt, unidentified
  source 1..201: mol_type = other RNA; note = Related to CABDVD010000002.1; note = Raoultella terrigena
tatggtattatcaggaaggtttcttctgcgatagcttagagggatctcgaatcgaaacgtatgaagcttgcttcatactttccatagcctcttgatttactagctgatctggccaacggttgctctttaagcggcctttaatgctcacggcgtgtaaagattgaactttgtatcgtggaagaaaccaactatgattaagag

SEQ ID NO: 17701 - RNA, 193 nt, Vibrio sp.
  source 1..193: mol_type = other RNA; note = Related to JAHUCN010000002.1; note = Vibrio fluvialis
tcagatatccttaggaaggtttcttctgcgatagcctagagggatcttgtatcgaatcgtacttcgtacattcctagcctcgtgattcactagctgtactcgtcatagtttacgctttaaatgttctttaaggctcacggcgtgtaaagattgaactttgtatcgtagaagaagccaccttgatgataaaaag

SEQ ID NO: 17702 - RNA, 193 nt, unidentified
  source 1..193: mol_type = other RNA; note = Related to NZ_CP057313.1; note = Klebsiella pneumoniae
ataagtataatagagaaagcttcttcttcgatagaagctgaggaattcagtctatctggataaggtgttcgccacctctagcctcagtaaaaactagctcgtcctttgcgcagttggcgccatggatgactttaatactcacagagtgtaaagattggtcttggtatcggagaagaagctttatgaaaaataa

SEQ ID NO: 17703 - RNA, 193 nt, unidentified
  source 1..193: mol_type = other RNA; note = Related to DAFBNF010000007.1; note = Providencia rettgeri
attagtataatagataaagcttcttcttcgatagaagctggggaatccagtttatctggataaggtgttcgccacctctagtctcagtaaaaactagctcatcctatgcgcacttggcgccatggataactttaatactcacagagtgtaaagattggtcttggtatcggagaagaagccttatgaaaaaaca

SEQ ID NO: 17704 - RNA, 193 nt, Citrobacter sp.
  source 1..193: mol_type = other RNA; note = Related to CP018810.1; note = Citrobacter freundii
attagtataatcgaacaagcttcttcttcgatagaagctgaggagtccagtttgactggataaggtgttcgccatctctagcctcagtaaaaactagctcatcctttgcgcacttggcgccataggtaactttaatactcacagagtgtaaagattggtcttggtatcggagaagaagctttatgaagacgaa

SEQ ID NO: 17705 - RNA, 192 nt, unidentified
  source 1..192: mol_type = other RNA; note = Related to JACYMS010000012.1; note = Pantoea agglomerans
ataactataatacaaaaagcttcttcttcgatagaagctgaggtagtcagttaatctggctaaggcgttcgacgcctctggcctcagtaaacactagcctatcctattcgcgtttggcgtcatggatgctttaatactcacagagtgtaaagattggtcttggtatcggagaagaagctacatgaaaaacaa

SEQ ID NO: 17706 - RNA, 181 nt, unidentified
  source 1..181: mol_type = other RNA; note = Related to NZ_JACSXJ010000009.1; note = Pantoea eucalypti
atatctataatagagcaggcttcttcttcgatagattcaggggagtataactgagcgattgtcgttcctagcccctgcaaacactagtttgccgccgccaatttgtcgcgatggccgctttaagcctcacggggtgtaaagatggtcttggtatcggagaagaagcttttatgaaagaaaa

SEQ ID NO: 17707 - RNA, 179 nt, unidentified
  source 1..179: mol_type = other RNA; note = Related to PDLA01000006.1; note = Klebsiella pneumoniae
atatctataatagagcaagcttcttcttcgatagatataggggagtttcactgaacgattgtcgttcctagcccctgcaaacactagtttgccgccgccaattgtcgcgatgtccgctttaagcctcacggggtgtaaagatggtcttggtatcggagaagaagctttatgaaagaaaa

SEQ ID NO: 17708 - RNA, 185 nt, unidentified
  source 1..185: mol_type = other RNA; note = Related to CP064054.1; note = Morganella morganii
tcacatattatagatcatgcttcttcttcgatagaagctggagggctcaaatgagttgacgcatgtcgtcacgtgctccagcaaacactagcttagattgctctgcgtccgctaagccactttaagcctcacggggtgtaaagatgttatgggtatcgaagaggaagcttttttatgaaacataa

SEQ ID NO: 17709 - RNA, 185 nt, Escherichia coli
  source 1..185: mol_type = other RNA; note = Related to CP057173.1
tcgcatatcatcgatcatgcttcttcttcgatagaagctggagggctcaaatgagctgacgcatgccgtcacttgctccagcaaacactagctcggattgtcttgcgtccgctaagccgctttaagcctcacggggtgtaaagatgttattggtatcgaagaggaagcttttacatgaaacataa

SEQ ID NO: 17710 - RNA, 185 nt, unidentified
  source 1..185: mol_type = other RNA; note = Related to NZ_MJAO01000006.1; note = Serratia marcescens
tcacatattattgatcatgcttcttcttcgatagaagctggaggactcaaatgagttgacgcatgccgtcacttgctccagcaaacactagctcggattatcttgcgtccgccaagccgctttaagcctcacggggtgtaaagatgttattggtatcgaagaggaagcttttttatgaagcacaa

SEQ ID NO: 17711 - RNA, 185 nt, Proteus sp.
  source 1..185: mol_type = other RNA; note = Related to SCIO01000007.1; note = Proteus mirabilis
tcgcatatcttagatcacgcttcttcttcgatagaagctggggaactcaaatgagttgacgtttgtcgtcacttgctccagtaaacactagcttgggtaatctcgcattcgccaggccgctttaagcctcacggggtgtaaagatgttattggtatcgaagaggaagcttttttatgaaacataa

SEQ ID NO: 17712 - RNA, 184 nt, unidentified
  source 1..184: mol_type = other RNA; note = Related to NZ_QGOK01000008.1; note = Marinomonas shanghaiensis
tcgtatattttagagcaagcttcttcttcgatagaagtggggggtgttcgcacctgatcgtttaacgattctagccctaatttactatctatctgtcaactatgcctttaagttgctagcaactcacggtgtgtaaagattgttcatggtatcggagaagaagctttcctcatatgtttaaaaa

SEQ ID NO: 17713 - RNA, 186 nt, unidentified
  source 1..186: mol_type = other RNA; note = Related to NZ_LR136958.1; note = Alteromonas sp.
gatgatatcatcaaaagagtttctttttgatagagtatagagactgatgtttacatcagtgagtgccctgacgctccgagctcttaattaccaactctgagcctggtctcaccgacacgtaacttttagtccacgagcgtgaaaagatgtttttagtatcaaaagaaactattaaatgaaaaagtt

SEQ ID NO: 17714 - RNA, 202 nt, unidentified
  source 1..202: mol_type = other RNA; note = Related to JACHBV010000002.1; note = Rahnella inusitata
tctagtatgatagaaatgcttcgtctcgatagagagaaagggaccatgtaaatggtttaagatctgctttgtcggacttgactagccctaataagaaacagttcctcctacgatggtatgattttctcggatgaacttttagtttcactgctcgtgaaaagttgttcttggtatcgggacgaagcacatttacaaatattat

SEQ ID NO: 17715 - RNA, 203 nt, unidentified
  source 1..203: mol_type = other RNA; note = Related to NZ_RHDS01000003.1; note = Curtobacterium plantarum
tatagtatgatagataagcttcgtctcgatagagggtaaggggccatgcaaatggttcaagatctgattcgtcagacttgactagccctaataaagaccagttcctcctacgatgttatgattatcttggatgagcttttagtttcactgcccgtgaaaagttgttcttggtatcgggacgaagcacattttatacattatta

SEQ ID NO: 17716 - RNA, 203 nt, unidentified
  source 1..203: mol_type = other RNA; note = Related to NZ_CP059956.1; note = Pectobacterium brasiliense
tatagtatgcttgaaaagcttcgcctcgatagaattaaaggggtcacgtaagtgatacaagatctatctaggtagacttggctagccctaataactaccagtttagctatgattattatagttgtcttagataaacttttagtttcactacacgtgaaaagttgttcttggtatcggggcgaagcgtttttgattttttcatt

SEQ ID NO: 17717 - RNA, 223 nt, unidentified
  source 1..223: mol_type = other RNA; note = Related to UHIX01000001.1; note = Yersinia enterocolitica
aatgctataatattaaagctccagaactgatagatatcgagggtattttccaaagtaaaagcttaatctcaaatggataatatgtgtagcataagactcaccaagcctcatgtaattaccagtttcgatttgttattttgacgataatcgtaaagtatacttttaattacacaacgtgaaaagttgttatttgtatcagttctggagtttccatgttaaacaa

SEQ ID NO: 17718 - RNA, 221 nt, unidentified
  source 1..221: mol_type = other RNA; note = Related to FCGU01000001.1; note = Serratia marcescens
aatgatataatagccaagctccagatctgatagataatgagggtgtattcattactaggcttaacctcatgagtacatgtgtagcacaagactcaccttgcctcgcgtaattaccagtttcgatttgtcatcttgttgataatcgtaaattacacttttaattacacaacgtgaaaagttgttatttgtatcagatctggagttttcattatgttaaaaaa

SEQ ID NO: 17719 - RNA, 211 nt, Proteus sp.
  source 1..211: mol_type = other RNA; note = Related to NZ_CP043925.1; note = Proteus columbae
tctgatataataaaaaatctccggttttgatagtttgaagggcacagtcacaggagcttaacctgattgtgtgctagcttaggtctggcctagcctgcattaaccagttagcttatgatttccctattggaatgttaaaggttacctttttaattgcacagagtgaaaatctgttattggtatcaagatcggagttttttatgattaagtt

SEQ ID NO: 17720 - RNA, 212 nt, unidentified
  source 1..212: mol_type = other RNA; note = Related to NZ_CP063241.1; note = Pectobacterium brasiliense
agtagtattttagacagacttcggttccgatagataaaggggtcataaatatttttgaatttatgacgaacgcttgacgttcctatggtcagattttggtctgatcagcctattattgactagctggtctcattagtcttacgtagactttgtaagccactaaagtgaaagtctgttcattgtatcggaaccgaagtaatcatgaataagat

SEQ ID NO: 17721 - RNA, 212 nt, unidentified; identical to SEQ ID NO: 17720
  source 1..212: mol_type = other RNA; note = Related to JACHAN010000001.1; note = Pectobacterium brasiliense

SEQ ID NO: 17722 - RNA, 210 nt, Citrobacter sp.
  source 1..210: mol_type = other RNA; note = Related to CP056181.1; note = Citrobacter freundii
agtgctattatagaaaaacttcggttccgatagataaaggggtcatgagttttttaatttatgacgaacgcttgacgttcccatggttagattttgttctgaccagcctattatttactagcgggtctcactagtctcaggtagactttctggggcactaaagtgaaagtctgttcattgtatcggaaccgaagtaaccatgaataagat

SEQ ID NO: 17723 - RNA, 207 nt, unidentified
  source 1..207: mol_type = other RNA; note = Related to NZ_WHOZ01000001.1; note = Pantoea agglomerans
agtgctatttttaaaaagcttcggttccgatagataaaaggatcataagtttttgatttatgatgagcgcttgacgttcctatgttcagatttttctgtacagcctattattgactagctggtctcaatggtctcaggtagcctttctggggcactaaagtgaaagcctgttcattgtatcggaatcggagtaaccatgaaaaaaat

SEQ ID NO: 17724 - RNA, 196 nt, Proteus sp.
  source 1..196: mol_type = other RNA; note = Related to JADSTY010000052.1; note = Proteus mirabilis
aatgagataatagacaagcttcggttccgatagatattgggggcataattatgttggttgcttgacagccctatagtcaaattttttggctagcccaacattaactagctggtctcactggtcatagtttaacttttaggccactaaagtgaaagtctgttcattgtatcggaatcgaagtaattatgaaaaaaat

SEQ ID NO: 17725 - RNA, 193 nt, unidentified
  source 1..193: mol_type = other RNA; note = Related to NVWN01000005.1; note = Arcobacter sp.
atgtcaattaaagaaaaactttagtttgatagacttggaattttattacttacgagtaaagaaatatatgcttgacatatctagtccttcaactactaatttgcttagatttttacaacgccttacagttgttggatccactgttgtgaaaaattgttctttgtatcaaactaggtttttttatgtataaaat

SEQ ID NO: 17726 - RNA, 196 nt, unidentified
  source 1..196: mol_type = other RNA; note = Related to JAIZPA010000057.1; note = Sulfurovum sp.
acaagtattgaaaccaagctaccgtctgataggtaagggactttgttactctcgagtaataaagtatatgctggacatatctagcccaaaaagtactagttcgcgctacttagctttagccttgactgatgctcacagtaaacttgtgagtcgttgttcttttgtatcagacacaaggtttcaatatgggtaaaat

SEQ ID NO: 17727 - RNA, 197 nt, unidentified
  source 1..197: mol_type = other RNA; note = Related to MICC01000016.1; note = Sulfurimonas sp.
atgcttatcgaaaaaaaactttagtctgataggtaagggattttatcacatttatgttttaaagtgtatgcttgacatacctagcctaaaaactactaagctgtcgctgttcagtatacgatatactggtagcgttgactcacgtgccgtgagatgttgttcattgtatcaggctaaagttcttcgatgaaaaaaat

SEQ ID NO: 17728 - RNA, 193 nt, unidentified
  source 1..193: mol_type = other RNA; note = Related to NZ_PDKB01000007.1; note = Aliarcobacter vitoriensis
tttgatataataacacttgtcgaaaagtctctatctgatagataagggatttaaaatgaattttttaaatatatgcttgacgtatctagcccaaaaagtactattgatttacagcattttagataaatctttagtccactttgtgaaatattgtaatttgtatcaggtatggtagcttttcgatgaaaataaa

SEQ ID NO: 17729 - RNA, 191 nt, unidentified
  source 1..191: mol_type = other RNA; note = Related to NZ_VWUH01000001.1; note = Pantoea sp.
tatagtatattaaacaggcttcgcacctgatagggataggggccatttggtggcgcaagctggacttgcctagccctatagctaccagcttcctcctaggcgtcacaggggttactggtcgcacttttagtgttcacgacacgtgaaaagatgttctttgtatcagggcgaagcttttttattaaaatgcc

SEQ ID NO: 17730 - RNA, 194 nt, unidentified
  source 1..194: mol_type = other RNA; note = Related to JAENMR010000003.1; note = Lelliottia amnigena
tttagtataatacataggcttcgcacctgatagacagaggggccattctttggcacaagcttgacttgtctagccctacagttaccagctcgcctcctaagcatcactaggtttactggtcgcacttttagttttcacggcacgtgaaaaggtgttctttgtgtcagggcgaagctttttttaacaaagtagaa

SEQ ID NO: 17731 - RNA, 194 nt, unidentified
  source 1..194: mol_type = other RNA; note = Related to NZ_CP011303.1; note = Serratia liquefaciens
tatagtataataaacaagcttcgcacctgatagatatagggaccatgacctggtacaagctcgacttgtctagccctttcaactaccagctcgcctctcagctatgcggtgatgcggtaagcgtacttttagttatcacgacacgtgaaaagatgttctttgtatcagggcgaagccaccctctttaacttaaa

SEQ ID NO: 17732 - RNA, 231 nt, unidentified
  source 1..231: mol_type = other RNA; note = Related to NZ_JACYTP010000002.1; note = Photobacterium arenosum
tatgatatcattcgtatgcttcaacccgatagtagaggggagatatgagtttcgacaagtatctgagagcttgcctctcccgctctttgcttgagggagtccaacttctttttgctttgggcatagtcctaatgactgctaatctggtcgctctgattagtatgtgtcgaagtacacacctacggtgtaatggtgttcttttgtatcgggttgaagctctatgattaaaaa

SEQ ID NO: 17733 - RNA, 229 nt, Vibrio sp.
  source 1..229: mol_type = other RNA; note = Related to BBMT01000003.1; note = Vibrio maritimus
tatgatatcattcgtatgcttcaaccgatagtagagggagatatgagtttcgacaattatctgagagcttgcctctcccgctctttgttagagagagttcaacttctctcttctttgggcatagtcctaatgactactaatctggtcactgtgattagtatgtgtcgaagtgcacacctacggtgtaatggtgttcttttgtatcgggttgaagctctatgatcaagaa

SEQ ID NO: 17734 - RNA, 234 nt, unidentified
  source 1..234: mol_type = other RNA; note = Related to JAJRLY010000005.1; note = Klebsiella pneumoniae
tatgatatcattcgtatgcttcaacccgatagtagaggggagatatgagtttcgacaaatatctgagagcttgcctctcccgctctttgcttgaggaagtccaacttctttttgctttgggcatagtcccaatgactgctaaactagtcactctgattagtatgcgtcggagtacacacctacggtgtaatggtgttcttttgtatcgggttgaagctctatgatgaaaaataa

SEQ ID NO: 17735 - RNA, 230 nt, Vibrio sp.
  source 1..230: mol_type = other RNA; note = Related to LWEH01000044.1
tatgatattattcgtatgcttcaacccgatagtagaggggagatatgagtttcgacatatatctgagagcttgcctctcccgctccttgcttgaaaaagtccaacttcctctagcttcgagcatagtcctaatgattgctaatttagtcactgtgattattgtgcgctaaatacacacctacggtgtaattgtgttcttttgtatcgggttgaagctctatgattaaaaa

SEQ ID NO: 17736 - RNA, 231 nt, unidentified
  source 1..231: mol_type = other RNA; note = Related to NZ_PNDJ01000020.1; note = Pseudoalteromonas sp.
tatgatattattcgaaggcttcaacctgatagtagaggggagatatgagttattacgagtatctgagagcttgcttctccagttctcagccacagaaaacctgttcttctgtggctttgagcgcagccccaataggcactaatctgatgtcgccgattagcatgcttctaagtcacacctacggtgtaatggtgttcttttgtatcaggttgaagcatctatgattaatac

SEQ ID NO: 17737 - RNA, 234 nt, Vibrio sp.
  source 1..234: mol_type = other RNA; note = Related to UHIJ01000001.1; note = Vibrio alginolyticus
tatgatattattcgtatgcttcaacccgatagtagaggggagatatgagttttcacgagtatctgagggcttgcccctccctctctttgtttctgggagttcgtcttccagtaactttgagtacagtcccaatagttactaatctggtcgcgctgattaatgtgtctgatagtacacacctacggtgtaatagtgttcttttgtatcgggttgaagcaatataatgaataaaaa

SEQ ID NO: 17738 - RNA, 200 nt, unidentified
  source 1..200: mol_type = other RNA; note = Related to NZ_MNAN01000032.1; note = Pseudoalteromonas byunsanensis
gatgatataattaagcggcttcaacccgatagtagaggggagataaaattgtaaagtctttatctgagggcctgttcctccagtcttcggacatagtcccattgattaccactcagttggctatattagcgtgtagaggggtcacacctgcggtgtaatgatgttcttttgtatcgggttgaagcacctatgaataataa

SEQ ID NO: 17739 - RNA, 230 nt, Vibrio sp.
  source 1..230: mol_type = other RNA; note = Related to CP017889.1; note = Vibrio alginolyticus
tatgatattattcgtatgcttcaacccgatagtaggggggagatatgagttattacgagtgtctgagagcttgcctctcccgctcattgattcaaggggttcgccctctttttgatttgagcacagtccctgtagttactaacttggtcgctacgattaatgtgatgtcgattcacacctacggtgtaatgatgttcttttgtatcgggttgaagcacaatgattaataa

SEQ ID NO: 17740 - RNA, 231 nt, Salmonella sp.
  source 1..231: mol_type = other RNA; note = Related to CP079839.1; note = Salmonella enterica
tatgatatcatcagaaggcttcaacccgatagtagaggggagatatgagtttttacgagtatctgagggcttgcccctccagtttgatgccattaagtgaaagttgctttttggctttaagcatagtcccaatagtgactaacctagtcactcgtattagtgtaaccgatgagtcacacctacggtgtaatgttgttcatttgtatcgggttgaagcaatatgaaaaataa

SEQ ID NO: 17741 - RNA, 192 nt, Vibrio sp.
  source 1..192: mol_type = other RNA; note = Related to NZ_JACVEG010000002.1
tatgatattataagaatgcttcaacccgatagtagaggggagatatgagtctagtacgaatatctgagagctggtctctcctagtcccaataattgccatttcaattggccatattattagtgtgcttaaaggtcacacctacggtgtaatgatgttcttttgtatcgggttgaagcacttatgaagaaaat

SEQ ID NO: 17742 - RNA, 208 nt, unidentified
  source 1..208: mol_type = other RNA; note = Related to NZ_WTLC01000042.1; note = Pseudoalteromonas sp.
tatgatattattcgaaagcttcaatccgatagtagaggagaggtatgagtctagtgcacatatcagagggcttgttcctccagcttttgaaagaaagcacagctccaatagtcactatcctatgcatgttgaattagtgtctgaatagttcacacctacggtgtaataatgttcttttgtatcggattgaagcaaacatgaaaaaaat

SEQ ID NO: 17743 - RNA, 194 nt, Aeromonas sp.
  source 1..194: mol_type = other RNA; note = Related to NZ_RJCW01000006.1; note = Aeromonas dhakensis
aatgatataatcgatatgcttcaacccgatagttgaggagtgatgtacgagccaagctctgcattagagggctagaccctcctagttcctatagttactagccatctagttggcgatcattagtggtctagtggcacaccttcggtgtaattttgttcttttgtatcgggttgaagcataaatatgaacgaaat

SEQ ID NO: 17744 - RNA, 199 nt, unidentified
  source 1..199: mol_type = other RNA; note = Related to CP069319.1; note = Kosakonia cowanii
tatgatataatccagaggcttcaacccgatagttaatgggagatataagcttcggtttatatctgagggctggaccctcccgtcgtttgacatagcccacgagtgactagttggcatcacgtgtgattagtctctggaaggcacacctgcggtgtaacgttgttctttgtatcgggttgaagcaactaatgaaattaat

SEQ ID NO: 17745 - RNA, 198 nt, unidentified
  source 1..198: mol_type = other RNA; note = Related to FMAY01000002.1; note = Kosakonia oryzendophytica
catgatattatccaaaggcttcaacccgatagttaacgggagatataagcttaggtgagtatctgagggctagtccctcctgtcttttgacatagcccacgagtgactagttagcatcaggtgtgattagtcgctggaaagcacacctacggtgtaacattgttctttgtatcgggttgaagcactaatgaaattaat

SEQ ID NO: 17746 - RNA, 231 nt, Vibrio sp.
  source 1..231: mol_type = other RNA; note = Related to NZ_CP090019.1; note = Vibrio kanaloae
catgatatattgacaaggcttcaacccgatagttaaagggagacgagtggttcactccacccattgagggtaaagcccttccacgaggttagaataatcttcatccaggttgttttttcctccgagtcccagaattatcaaatgattacaatttataaatgttatcattcggtcaccttcggtgtaactttgttcttttgtatcgggttgaagcaacattatgaaaaaaat

SEQ ID NO: 17747 - RNA, 231 nt, unidentified
  source 1..231: mol_type = other RNA; note = Related to WMDK01000003.1; note = Photobacterium carnosum
tatgctatattgaacaggctttatcctgatagacttcagagatcattatctcaatagggttaatgacaagagggaactcttcaggagtttgacttcaactatttatagatgattttgagctccaacgtctctagatcacagcttgattacagttatgtcaatgtgttcaatgtgtcacacagtgaatttttgtttttgtatcaaagataaagcgtattatatgtcaaaata

SEQ ID NO: 17748 - RNA, 231 nt, Vibrio sp.
  source 1..231: mol_type = other RNA; note = Related to MCSX01000068.1; note = Vibrio cyclitrophicus
tatgctatattgaacaggctttatcctgatagacttaagagatcactatctcatgttagttagtgaaaagaggtaactcttcagaagtcaaatatccatcttagttggtggtgattgatctcaacgtctctaaacggtagcttgattaccgttatgttaaatgtgttcaaagtgtcacgcagtgaatttttgtttttgtatcaaagataaagcgtattgtatgtcaaaata

SEQ ID NO: 17749 - RNA, 198 nt, Aeromonas hydrophila
  source 1..198: mol_type = other RNA; note = Related to JAEHJS010000001.1
catggtatggttaacttgctctcttttgatagcacaagggaatgaatttcgattcattgcacgggtaacctgccagcacattttaagtaatgtgcatcgtccctatacaccagccatgtcgacgtgtcgacgctggccactgggtgtcacgcagtgatggcgtggattgtatcaaaagagggcctttatgaataaaac

SEQ ID NO: 17750 - RNA, 232 nt, Citrobacter sp.
  source 1..232: mol_type = other RNA; note = Related to CP057863.1; note = Citrobacter freundii
gatggtatcatcagaaatgtttacattcggtagtaatagagattgccttgtgcaatgtaggggaacctaccatctatctttgcgacagtgtagattttatatcattagtaaaattttatgcttaagcttggttagaacagtctccacataccagtgtgattactttgatattcgcgcattatgtgtcacacgtgaatgtttgtttttgtatcggattaaacatgaaaataac

SEQ ID NO: 17751 - RNA, 179 nt, unidentified
  source 1..179: mol_type = other RNA; note = Related to PNCI01000020.1; note = Pseudoalteromonas rubra
tatgttacaatttctcagctacgttacggtagctaaaaggggaaagcttgctttaaaaggtcactacctttcaagcccttatttactagctccatgacgcctagtagttcgcttctaaagcttcactaaagtggaactttgtaatttgtaccgtgacgtagctagcttatgaaattatc

SEQ ID NO: 17752 - RNA, 178 nt, unidentified
  source 1..178: mol_type = other RNA; note = Related to NZ_AHBZ03000021.1; note = Pseudoalteromonas citrea
tatgatactatttctcaactacgttacggtagttagaaggggaaagttcgctttaaaaggttgttacctttcaagcccttatttactagctccatgcgcctagtagttcgattctaaaatcccactaaagtggaactttgtaatttgtaccgtaacgtagcctacttatgaaattatc

SEQ ID NO: 17753 - RNA, 179 nt, unidentified
  source 1..179: mol_type = other RNA; note = Related to NZ_CP045418.1; note = Pseudoalteromonas sp.
tatgatactctttctcagctacgttacggtagttcagaaggggaaagcttgctttaaaaggttgtcacctttcaagcccttatttactagctccatatgtctagtagttcgattctaaaatcccactaaagtggaactttgtaatttgtaccgtaacgtagccaacttatgaaattatc

SEQ ID NO: 17754 - RNA, 178 nt, unidentified
  source 1..178: mol_type = other RNA; note = Related to NZ_CP055159.1; note = Shewanella algae
tatggtataatctccgagctacgttacggtagctaacggggaaagttcgcttttgaaggttgttaccttccaagcccttgtttactagttatattacaatgtgtcgacagttttgatgacactaaagtgaaactttgtaatttgtaccgtaacgtagcgattataaaatgaaaaaaat

SEQ ID NO: 17755 - RNA, 177 nt, unidentified
  source 1..177: mol_type = other RNA; note = Related to JADYXO010000004.1; note = Pseudoalteromonas sp.
tatggtattattactcagctacgttacggtagctgacggggaaagcttgctttcaaaggttgttacctttccagcccctgttcattagatgtatcactcgctattcgtagtttgctgatcactgaagtgaaactttgtaatttgtaccgtaatgtagcaaataattatgtcaaaaat

SEQ ID NO: 17756 - RNA, 223 nt, unidentified
  source 1..223: mol_type = other RNA; note = Related to JADYXL010000003.1; note = Pseudoalteromonas sp.
catgatataataacaaggcttcaatctgataggtaatgggaacggtttagttattaatttaacttaattgtaagggcttgtcccttcatgaacttaatataactagttcataaataaataaatagtctctcagtcagcagttcattgtcagcgtgtctgagtactcaaggtcacatgtgcaactctgaaaatgtatcagattggagcaattgatgaaaacaat

SEQ ID NO: 17757 - RNA, 144 nt, unidentified
  source 1..144: mol_type = other RNA; note = Acidobacteria bacterium; note = Related to JAFDVW010000003.1
tccaagccggtccataggcagcttcggctccattggatctctctggggttaccccaggggaacgtgcatagcttaggtttcatcgcgtgaacggccctgcgcggccgcgcagacatggtcacgcacagtgagactcgttggttg

SEQ ID NO: 17758 - RNA, 149 nt, unidentified
  source 1..149: mol_type = other RNA; note = Acidobacteria bacterium; note = Related to JAFAPG010000514.1
tccaagcatagcttgtcttgagccctagtggcttggtcaggcttctccggggttaccccggggcaacgtgaaaaactgacaattcgtcgcgtgagctttgctgcgcgccagcgcaggcggggctcatgcagagtgagactggttggagc

SEQ ID NO: 17759 - RNA, 145 nt, unidentified
  source 1..145: mol_type = other RNA; note = Acidobacteria bacterium; note = Related to QHZV01000271.1
tccaagctggtttgatcgagctttcgggctcggttgggcctctctgggggttaccccaggggaacgtgaagaactgacattccggcgctagagcttaactgcgcgttgcgcaggcctgctcatgcaaggtgggactcgttggagt

SEQ ID NO: 17760 - RNA, 147 nt, unidentified
  source 1..147: mol_type = other RNA; note = Acidobacteriia bacterium; note = Related to JAIQGJ010000043.1
tccaagccggtctgatcgagctcttttgggttcggtttggcctctctggggttaccccagggaattgcgagacctcgggatttcatcgcgtgagcggccctgcgcgactgcgcagatttgctcacgcaaggcaagactcgttggagc

SEQ ID NO: 17761 - RNA, 147 nt, unidentified
  source 1..147: mol_type = other RNA; note = Acidobacteria bacterium; note = Related to QHYC01000242.1
tccaagcttggcttttatcgagctctcgggctcggtttggcctccctggggttaccccagggaaacgtgaagaactgagatttcgtcgcgtgagcttcgctgcgcgactgcgcaggcctgctcatgcaaggtgagactcgttggagc

SEQ ID NO: 17762 - RNA, 136 nt, unidentified
  source 1..136: mol_type = other RNA; note = Related to QIAA01000032.1; note = Acidobacteria bacterium
tccaagcggaccttcgggtttgctttgagcctctctggggttaccccaggggaacgtgaacgactaggctttcatcgcgtgagcggcgctgcgcgactatgcagttatgctcacgccgggtcagacaggttggggc

SEQ ID NO: 17763 - RNA, 147 nt, unidentified
  source 1..147: mol_type = other RNA; note = Acidobacteria bacterium; note = Related to JAFDVQ010000015.1
gccaagccgggcttgcatcgggactcgcgttccggtgcggtcctctccggggctaccccagggaaaagtgaataactggagattcatcgggtgatctcaaccacgcgctgcgtggggctgatcacgcaaggccagactcgttggcgt

SEQ ID NO: 17764 - RNA, 145 nt, unidentified
  source 1..145: mol_type = other RNA; note = Acidobacteriaceae bacterium; note = Related to JAFAQG010000033.1
tccaagccggtgcgaatcgggccttgccgttcggttccatctctccggggttaccccggggtaacgtgaagaactcacatttcgtcgcgtgaggttcgctgcgctccgcgcagaacttctcacgcagtgccagactcgttggggc

SEQ ID NO: 17765 - RNA, 147 nt, unidentified
  source 1..147: mol_type = other RNA; note = Acidobacteria bacterium; note = Related to QIAH01000498.1
tccaagctggtgtggaacgggctctcgtggcccgcctgcatctctctggggctaccccagggaaacgtgtagagctgacaattcgtcgcaagaccttctctgcgagtccacgcaggactggtcatgcaaggtgagactcgttggagc

SEQ ID NO: 17766 - RNA, 148 nt, unidentified
  source 1..148: mol_type = other RNA; note = Related to JAFKEE010000018.1; note = Acidobacteria bacterium
tccaagctcggtctggatcggtctccaatggtcggttcagcctctctggggttaccccagggcatcgggaatagccaggcattcgtcgcgtgcgcttcggctgcgctgtcgcgcagttctgcccacgccaggtgagactcgttggagc

SEQ ID NO: 17767 - RNA, 148 nt, unidentified
  source 1..148: mol_type = other RNA; note = Related to NZ_CP063849.1; note = Paludibaculum fermentans
tccaagctcggtctgaatcggtcattcgtgttcgattcagcctctctggggttaccccagggcatcgggaatagccaggcattcgtcgcgtgtgcttcggctgcgctgtcgcgcagttctgcccacgccaggtgagactcgttggagc

SEQ ID NO: 17768 - RNA, 148 nt, unidentified
  source 1..148: mol_type = other RNA; note = Related to JACJWB010000023.1; note = Bryobacterales bacterium
ctcgagctcggcgttggttgagcgtttacgtttgacccctcgcctctccggggataccccgggggatgttggtgtgtctccattgcagcgcgcgagcttcgccgcgtccgaagcggaaccgctcgcgcagggtgggattggtcgggtt

SEQ ID NO: 17769 - RNA, 147 nt, unidentified
  source 1..147: mol_type = other RNA; note = Bryobacteraceae bacterium; note = Related to JACMLA010000763.1
tccaggccgggccgtcgctggaatcttcggattcggttaggtctctctggggctaccccagggcatcactctaagcaggcaattcgtcgcgcgagcaaccctgcgctgtacgcagaaacgctcgcccaaagtcagactcgctgggta

SEQ ID NO: 17770 - RNA, 144 nt, unidentified
  source 1..144: mol_type = other RNA; note = Related to JAFAUE010000361.1; note = Acidobacteria bacterium
ttcaagttggctcgggttgggcttaggcccaatttgggtctccctggggataccccagggaatggagaatgactgggatttcgtcgcatgagcgaccctgcctaaaaggcagacctgctcacgcagagtcagactggttgagcg

SEQ ID NO: 17771 - RNA, 150 nt, unidentified
  source 1..150: mol_type = other RNA; note = Related to JAEUQG010000434.1; note = Bryobacterales bacterium
tccaagcgctggtgcaatcgagcccctgaggtccggttcgccttctccgaggctacctcgcgaggattgtgttacgccgccattgcgtcgcgtgcgcgcgtctgcactgagcgtgcagtacagcgcacgccgggttggacaggttggatc

SEQ ID NO: 17772 - RNA, 151 nt, unidentified
  source 1..151: mol_type = other RNA; note = Related to JAFDVS010000120.1; note = Acidobacteria bacterium
tccaagcaaggtgtcatgcgtgctttcgtggcccgtatgcgccactccgaggttacctcgggggtattttctgatgtcgccgattcgtcgcgtgagcgtgcactgcgcctgacacgcagatgtgctcacgccatgtaggacaggttggacc

SEQ ID NO: 17773 - RNA, 146 nt, unidentified
  source 1..146: mol_type = other RNA; note = Acidobacteria bacterium; note = Related to JAFDVZ010000005.1
ttcaagctaggcggcatcgggctttcgggttcggttacgcctctccggggataccccgggggagaggtttgagttcgcatttcgtcgcgtgaggcccgccgcgctccgcgcggatcagctcacgcatccgtcagacacgttggagc

SEQ ID NO: 17774 - RNA, 146 nt, unidentified
  source 1..146: mol_type = other RNA; note = Bryobacteraceae bacterium; note = Related to JAIEMJ010000003.1
tcccagcttggcgccagaccgttcggtgcctctctggggttaccccagggaatttctgtagtagtccgtttcgtcgcgtgagcgggcgcctgcggcgcactacgcttcgcgtagatctgctcactcctggtgagatacgtgggagc

SEQ ID NO: 17775 - RNA, 144 nt, unidentified
  source 1..144: mol_type = other RNA; note = Bryobacterales bacterium F-183; note = Related to AP025252.1
tgcaagctggtgtgtgtttatccaaacatgcgcctctccggggttaccccggggcatgctgttgatttgccacatttcgtcgcgcgaagatgcaggcgtgcgcaagcgcacgaacccttcgcctaaggtgagacacgttgcatg

SEQ ID NO: 17776 - RNA, 147 nt, unidentified
  source 1..147: mol_type = other RNA; note = Related to JAEUQE010000020.1; note = Bryobacterales bacterium
tccaagtttggcgcttgccggatgacatgtctggctcagcccctctggggttaccccagggcgtattcgtaagctgatcgttcatcgcgtgagccgtcactgcgccagggcgcagatgcgcgcacgcagcgtgagactggttggatt

SEQ ID NO: 17777 - RNA, 153 nt, unidentified
  source 1..153: mol_type = other RNA; note = Bryobacterales bacterium; note = Related to JAEUQF010000393.1
tccaagcccggcaatggccgcatccgtcatcggttccgccaaagcctctttggggttaccccagggaatgtccgttacctccgcacttcgtcgcgtggacggcacctgcgccacggcgcagacaggtccacgcacagtgagtcccgttggagg

SEQ ID NO: 17778 - RNA, 152 nt, unidentified
  source 1..152: mol_type = other RNA; note = Related to JADLFK010000145.1; note = Gemmatimonadaceae bacterium
ttcaagccggttgctccgtactgctgatcacagcacggacgcgccactccggggataccccgggggtgtacaggaaagagagaattcatcgcatgcgctccgctgcagccttcacggcagtatcgcgcacgcacagtcagactcgttggagc

SEQ ID NO: 17779 - RNA, 160 nt, unidentified
  source 1..160: mol_type = other RNA; note = Phycisphaerae bacterium; note = Related to JACMJE010000135.1
tccaagccggtactccgcgggttgtgccagccgtgccgcgcgtaccaatccggggctaccccgggtgttcgtatgaagcttctatttcgtcgcaggagcggccactgcgatcgctgcgctcgcgcagttcccgctcgcgcaaggtcagattcgttggaac

SEQ ID NO: 17780 - RNA, 146 nt, unidentified
  source 1..146: mol_type = other RNA; note = Related to JAEUQC010000130.1; note = Bryobacterales bacterium
cctaagccggttgaatcacggcagttcctgcccggttgaaccactctggggtatccccagggatcttttccgatggagcatttcgtcgcgtgaccgccgctgcgccttgcgcagatatggtcacgccaggtgagactcgttgggac

SEQ ID NO: 17781 - RNA, 124 nt, unidentified
  source 1..124: mol_type = other RNA; note = Related to NZ_SDMK01000004.1; note = Acidipila dinghuensis
tccaagccggccgcaaggtctctccggggctaccccggggcaacgtgtggaatacagcaggcaccgcatgagcctccctgcacgctgtgcagatccgctcacgcaaagtcagactcgttggagc

SEQ ID NO: 17782 - RNA, 148 nt, unidentified
  source 1..148: mol_type = other RNA; note = Acidobacteria bacterium AB60; note = Related to VANK01000001.1
tccaagctggcaagggaagaagccctcgggcctcgcccttacctctctggggttaccccagggcaacgtggcaatccgggcactcgtcgcgggagcctcgctgcgctcgcacgcagatcagctcccgccaggtcagactcgttggagc

SEQ ID NO: 17783 - RNA, 144 nt, unidentified
  source 1..144: mol_type = other RNA; note = Related to NZ_SIHJ01000001.1; note = Posidoniimonas corsicana
accaagcttgccgaatccgcggttcgcccgcgtctcggctctctggggttaccccagggcagattgaagggttcgcgtttcagcgcgtgaggtgccatgcgcgcctacgcatcgtacctcacgcccgaccagactcgttggtgg

SEQ ID NO: 17784 - RNA, 143 nt, unidentified
  source 1..143: mol_type = other RNA; note = Related to NZ_SJPO01000016.1; note = Posidoniimonas polymericola
ctcaagcttgctgatcgttggttcgtccgcggctcggctctctggggctaccccaggggaggttgaagggttcgacgttcgtcgcgtgaggcgccatgccctccggtgcatgattcctcacgccagaccagactcgttgggcg

SEQ ID NO: 17785 - RNA, 145 nt, unidentified
  source 1..145: mol_type = other RNA; note = Related to CP036291.1; note = Pirellulimonas nuda
tccaagctcgttgagattggaggtccgtcttcgtctcgactctctggggttaccccagggcaatatgaagggttcgtgattcgtcgcgtgaggtgcgatgcgctgctacgcatcattcctcacgccagaccagactcgttggggc

SEQ ID NO: 17786 - RNA, 143 nt, unidentified
  source 1..143: mol_type = other RNA; note = Related to PNKX01000009.1; note = Pirellula sp.
ttcaagccggttagcttgggccgttaaggtcgactaacctctctggggataccccaggggatcgtgaaagggttggatttcgccgcgtgagcgaagatgcgcggtgcgcatgaatgctcacgctagaccagtctcgttgagat

SEQ ID NO: 17787 - RNA, 145 nt, unidentified
  source 1..145: mol_type = other RNA; note = Planctomycetaceae bacterium; note = Related to RECD01000177.1
tccaagccggtgaggtcgagcgtgctgcgttcgattcgcctctctgaggttacctcaggggatcatgaagggctaggatttcgaggcgtgagcgtcgatgcgctaccgcgcataatagctcacgccggacaagactcgttggagt

SEQ ID NO: 17788 - RNA, 145 nt, unidentified
  source 1..145: mol_type = other RNA; note = Planctomycetales bacterium; note = Related to JAGQPE010001238.1
tccaagctggttgcgtcccgtgaactcgcggcgatgcgactctctggggttaccccagggcatgatgaagggtttcgatttcgaggcgtgagccgcgatgcgttgtcacgcatagttgctcacgcaggaccagactcgttggggc

SEQ ID NO: 17789 - RNA, 144 nt, unidentified
  source 1..144: mol_type = other RNA; note = Related to NYXM01000103.1; note = Planctomycetaceae bacterium
gtcaagccggcaaggatcggacctttgagttcgacctgtctctctggggataccccaggggatcgtgaatggttaggatttcgtcgcgtgagtcggaatgcgctccacgcatgatgactcacgctggaccagactcgttgaggt

SEQ ID NO: 17790 - RNA, 143 nt, unidentified
  source 1..143: mol_type = other RNA; note = Related to JAAYAY010000047.1; note = Planctomycetaceae bacterium
tccaagccggcaaagatcgaacctcgcgttcgtcttgcctctctggggctaccccaggggatcgtgaaacgttaggattgcgtcgcgtgagcgttgatgcgtttcacgcatagccgctcacgccggaccagactcgttgggat

SEQ ID NO: 17791 - RNA, 143 nt, unidentified
  source 1..143: mol_type = other RNA; note = Related to SJPS01000003.1; note = Bythopirellula polymerisocia
cccaagctggttacgctcgaacttaaagttcgactaacctctctggggctaccccagggaatcgtgaatggttgaatttccggcgcgtgagctgcgacgcgttccacgcatgatagctcacgctggaccagactcgttggggt

SEQ ID NO: 17792 - RNA, 147 nt, unidentified
  source 1..147: mol_type = other RNA; note = Planctomycetales bacterium; note = Related to JAGQOY010000114.1
tccaagccggcaaaagtcgactggaaagtctactctttgtctctctggggataccccagaggatcttgaaggaattggcatttcgtcgcgtgagtaaccatgcgttgacacgcatcaacactcacgcccgaccagattcgttgggat

SEQ ID NO: 17793 - RNA, 147 nt, unidentified
  source 1..147: mol_type = other RNA; note = Related to JAGQOX010000111.1; note = Planctomycetales bacterium
ctcaagccggcaaagtgtcaccgcgaggttgacatcgttgcctctctggggttaccccaggggatcatgaaaggttcggatttcgacgcgtgagtcaggatgcgatcccacgcataacaactcacgccagaccagactcgttgaggt

SEQ ID NO: 17794 - RNA, 148 nt, unidentified
  source 1..148: mol_type = other RNA; note = Planctomycetales bacterium; note = Related to JAGQPK010000195.1
cccaagctggcggaagactggcttgaaagtcaatgcttcagcctctctggggataccccaggggatcgtgaatgactagcaattcgtcgcgtgagttcccctgcgctgacacgcagaatgactcacgccagaccggactcgttgggag

SEQ ID NO: 17795 - RNA, 147 nt, unidentified
  source 1..147: mol_type = other RNA; note = Planctomycetaceae bacterium; note = Related to JAGQQK010000642.1
actaagcgggtgctgttcctgctctgcaggtgcaaacacctcttcggggttaccccgaggaatcgtgaatggtcagtcattgacgtcgcgtgagcggagatgcgcagacacgcatgattgctcacgccgaaccagtttcgttagttt

SEQ ID NO: 17796 - RNA, 146 nt, unidentified
  source 1..146: mol_type = other RNA; note = Related to DNWZ01000023.1; note = Planctomycetaceae bacterium
cccaagctgatctgtgtcattcccatcggttctggcacgatctccctggggataccccagggcaatgaattgttcgcttttcatcgcacgagcggccttgcgcgcgacgcgcaaaatagctcgcgctaaacgtgactcgttgagac

SEQ ID NO: 17797 - RNA, 144 nt, unidentified
  source 1..144: mol_type = other RNA; note = Related to JAGQPD010000106.1; note = Planctomycetales bacterium
gtcaagcttgtttcgactagccgatgtgccggtggaaactctctggggttaccccagggaaccgtgaaggagtgacatctcgtggcgtgagcaaagatgcgagccttcgcatagccgctcacgcccaaccagactcgttgttgc

SEQ ID NO: 17798 - RNA, 147 nt, unidentified
  source 1..147: mol_type = other RNA; note = Related to CP036289.1; note = Bremerella volcania
gttaagctgatttcctcttcatctgtttcagtgaatgaaatctctccggggataccccggagcaccctgaatggtaagcaattccatcgcttgagcaacgatgcgcctcgcgcatgatggctcaagccagactagacgcgttagcca

SEQ ID NO: 17799 - RNA, 146 nt, unidentified
  source 1..146: mol_type = other RNA; note = Related to QPEW01000030.1; note = Blastopirellula cremea
gttaagctgatttcgatttcattttctgagtgaacgaaatctctccggggctaccccggggcatcctgaatggtaagactttccgtcgcgtgagctgcgatgcgccccacgcattactgctcacgccagactagccgcgttagcca

SEQ ID NO: 17800 - RNA, 146 nt, unidentified
  source 1..146: mol_type = other RNA; note = Related to NZ_QPEV01000005.1; note = Blastopirellula cremea
tccaagctggccttgcttttgcttcggcttcgttaggcctctctggggttaccccaggggatcgtgaatggttagactttccgctgcgtgagtgcccgatgcccgcctaggcatgattcctcacgccgaacgagactcgttggtaa

SEQ ID NO: 17801 - RNA, 143 nt, unidentified
  source 1..143: mol_type = other RNA; note = Related to NZ_CP083740.1; note = Bremerella volcania
gttaagctgggcttgaagaccatcgcgtcgaccaggcctctctggggttaccccaggggatcttcagtggttgtccatttcgccgcgtgagttgacctgcgtttcacgcagaacgactcacgccagaccggattcgttagcca

SEQ ID NO: 17802 - RNA, 144 nt, unidentified
  source 1..144: mol_type = other RNA; note = Planctomycetales bacterium; note = Related to JAGQOV010001318.1
cctaagctggcaaggcgacgcgatggcgttgaaccggcccctttggggttaccccaaggaatttggtagagttggacatgtcggcgcgtgagcgacgaagcgccccgcgcttcacggctcacgccagaccagactcgttaggat

SEQ ID NO: 17803 - RNA, 146 nt, unidentified
  source 1..146: mol_type = other RNA; note = Related to NZ_JH636435.1; note = Schlesneria paludicola
cttctggtttggcaggcttcgtttacgacagccttcctgttcggggcaaccccgaaacattttgtttgacgcgttacagacctgcgcacgaacgtgcggccacgtcaatggccgtaagttcgcgcctcacgagacttggcgaagtg

SEQ ID NO: 17804 - RNA, 136 nt, unidentified
  source 1..136: mol_type = other RNA; note = Related to CP036268.1; note = Planctomycetes bacterium Pan189
cctcggctattggctcgtcacgaacgagtcgccacggggttaccccgcggcttaattcgcaacgacgcatttcggggcacgacggatgatccgctaccacggataattcgtcgcgcatcacgctgctggcgaggtg

SEQ ID NO: 17805 - RNA, 147 nt, unidentified
  source 1..147: mol_type = other RNA; note = Planctomycetaceae bacterium; note = Related to JADZEF010000070.1
tcccggtggttgcggtcggaaccttttccgtgctgcgatctccctgcggttaccgcagggaattgactgtgccctgtccttcacgtcgcgtgagcccctgtccgccttgcggacgacagctcacgcctcacgagctccggcgggaat

SEQ ID NO: 17806 - RNA, 147 nt, unidentified
  source 1..147: mol_type = other RNA; note = Related to JABMPE010000532.1; note = Rhodopirellula sp.
attcagttgggtatggcttccacctggtgtgcaagtcctgcctctgcggggttaccccgtggatgcgattctataccgtcatttcggcgcgtgaccgggaatccagttcctggataataggtcacgcctcacgaggctggtgaatcg

SEQ ID NO: 17807 - RNA, 141 nt, unidentified
  source 1..141: mol_type = other RNA; note = Planctomycetaceae bacterium; note = Related to JAGQQF010000113.1
cttctggtggtggtgaacgacgcgttgcgacgttgaccgttccggggcaaccccggacttgtgagtttgctcccttttcaccgcgtgagccattgtccgctccacggaccaccgctcacgcacaacgggactggcgaagcc

SEQ ID NO: 17808 - RNA, 143 nt, unidentified
  source 1..143: mol_type = other RNA; note = Related to NZ_CP011270.1; note = Planctomyces sp.
cttcggttctcgccgttcggtcgattcgatcggaaggccgctcctgggcaccccaggagcgaaggtggtgctggcagaacgtcgcgtgagcgattgtccgcggctgcggaccgtagctcacgccggacaagactggcgaagca

SEQ ID NO: 17809 - RNA, 133 nt, unidentified
  source 1..133: mol_type = other RNA; note = Planctomycetaceae bacterium; note = Related to JACKHO010000006.1
tccatgcttgtgagatttcatctcacttcgtccgaggtaacctcggagaacaaagtcagcctgatcattgcgaggtacgaacagttctccgcttcacggagtgcagttcgcacgcgaccagttgcgatggaac

SEQ ID NO: 17810 - RNA, 136 nt, unidentified
  source 1..136: mol_type = other RNA; note = Related to NZ_CP036271.1; note = Caulifigura coniformis
cacaagcatcatgttcccttcggggaacgctgcggggttaccccgcggtcgaagcgttgccggccattcgaacgggaatcgacgcgcggtgggcccttccaccgcagcctcgattcgccacaggagtcgttgtgcg

SEQ ID NO: 17811 - RNA, 138 nt, unidentified
  source 1..138: mol_type = other RNA; note = Related to NZ_FOQD01000001.1; note = Planctomicrobium piriforme
cttcagcgggtgattgttttcgaacgatcatcatctcggggacactccgaggactgtgacgcaaccccgcatcgattgcaggagcggccttccgcgtttgcggaaatttgctcccgccagacgaggactggtgaagac

SEQ ID NO: 17812 - RNA, 149 nt, unidentified
  source 1..149: mol_type = other RNA; note = Verrucomicrobiaceae bacterium 5K15; note = Related to JAFBGL010000010.1
gccaagattggtggaatgtgacatctccgatgtaatattccgcctctccggggtaaccccggggcacaggaaagctgagacacggcgcagccaagggctcgtcccactgccatgggagaatcccttggccgtaatggataggttggctc

SEQ ID NO: 17813 - RNA, 128 nt, unidentified
  source 1..128: mol_type = other RNA; note = Related to NZ_NIDE01000017.1; note = Fimbriiglobus ruber
gtcaagccgtgtggcaacacactctccggggttaccccgggggatttcgttacgtgccgattccgtcgcgtgacagccgatccactatgtggataatttgtcacgccctggctgagtcaggttgacgc

SEQ ID NO: 17814 - RNA, 138 nt, unidentified
  source 1..138: mol_type = other RNA; note = Related to NZ_BMXI01000009.1; note = Roseibacillus persicicus
tgcaagacagggagtggcgtcagccatgaccgctccggggctaccccggggactagaaaaaccgaaccgattcgaggcctcgggccttttcacggcctaccgtgaggctgcccgaggcatgaccagactggttgcagg

SEQ ID NO: 17815 - RNA, 163 nt, unidentified
  source 1..163: mol_type = other RNA; note = Related to NZ_ANOH01000392.1; note = Rhodopirellula sp.
accaagttagacatctggtgatcactctcgaaatatcgggagaacatcggtgtcccacgcgaggatacctcgcgggaatcacttgttcagagcattgatcgcgtgagcgattatccgactgccgtcggatttgagctcacgcagcactcggaccggttggcgt

SEQ ID NO: 17816 - RNA, 164 nt, unidentified
  source 1..164: mol_type = other RNA; note = Related to NZ_JACHXU010000006.1; note = Rhodopirellula rubra
accaagtcagacgtctttcgttcgctctcaacctgttgagaaaggcgatggatgtctcacgcgaggttacctcgtgggatagtcacatcagagcattgaaagcatgagcgagcatccgactcccgtcggataatagctcacgcaacactcggaccggttggtgc

SEQ ID NO: 17817 - RNA, 163 nt, unidentified
  source 1..163: mol_type = other RNA; note = Planctomycetales bacterium; note = Related to JAGQPR010000068.1
ttcaagacttgcttcgtatgggatcgacttggtcggtcagtgcatgcgaagtaccacgcgaggttacctcgcgggcgaaagatactctagcgatcgattacgtgagctttcatccgactaccgtcggatactggctcacgcagacacttcgacgggttgaatc

SEQ ID NO: 17818 - RNA, 158 nt, unidentified
  source 1..158: mol_type = other RNA; note = Related to SJPU01000001.1; note = Planctomycetes bacterium Poly21
accaagatcggtgttcgacggttgtgtcagcaacgtcgttgaaagcaccccacgcgaggttacctcgcgggctattttgcgctaggctttgattgcgcgagcaaccatccgtctaccgacggataacggctcgcgcctccacttggacaggttggatt

SEQ ID NO: 17819 - RNA, 157 nt, unidentified
  source 1..157: mol_type = other RNA; note = Related to JADYZV010000153.1; note = Pirellulaceae bacterium
accaagttcgacgtttgcgtaacggcgttttcgcagttgccaaatgttctgcgcgaggttacctcgcgcaatttacttagccaggcactgattgcacgagcaaccttgcgtctaccgacgcaatatggctcgtgcccacactcggaccggttgggaa

SEQ ID NO: 17820 - RNA, 153 nt, unidentified
  source 1..153: mol_type = other RNA; note = Planctomycetes bacterium K23_9; note = Related to CP036526.1
accaagttgattggtagccggatcgattgatacgactgccatttgccgcgaggttacctcgtggtagttgccttacttagcaagttgaccacgcgagcttggctgcgtctgccgacgcagggaagctcgcgcaggacgtggacgagttggcgc

SEQ ID NO: 17821 - RNA, 141 nt, unidentified
  source 1..141: mol_type = other RNA; note = Pirellulaceae bacterium; note = Related to JABDKS010000522.1
acttagctgcacgctgtcgattgtgcgctgatggccacgaggttacctcgtggcagtgacacgactgagcgattgaccgcacgagcttgcctgcgtctaccgacgcagcgaggctcgcgcgagacgcggaccggttggctc

SEQ ID NO: 17822 - RNA, 135 nt, unidentified
  source 1..135: mol_type = other RNA; note = Planctomycetales bacterium; note = Related to JAGQOZ010000019.1
tccaagctgacggagcgtttgccttcgtctccctggggatactccagggtaagatactaactctgatttcatgggcaggtttcctccgcgttgccacgcggaattgacctgcgccagacacggactcgttgggct

SEQ ID NO: 17823 - RNA, 166 nt, unidentified
  source 1..166: mol_type = other RNA; note = Related to JAEUHH010000058.1; note = Verrucomicrobiales bacterium
tccaagctggtgaatctccgtctgcgaacccgtcagggagcgcaggcggcgtcacctttccggggcatccccggggatacgacactccgacccaccgccgcgcgcggcccaaagggcgacaggcctgccgcccgcccggccgcgccggacagggacacgttggggc

SEQ ID NO: 17824 - RNA, 148 nt, unidentified
  source 1..148: mol_type = other RNA; note = Acidobacteria bacterium; note = Related to VFZW01000070.1
tccaagcttggttgaatcggactttcgcaagttcgtttcttccgctccggggataccccggggaccctcgtgggacttagcattcgtcgcgtgagcttcggcgcgtgaggtcgcgcgaacgctcacgctgggctggactcgttggggc

SEQ ID NO: 17825 - RNA, 129 nt, unidentified
  source 1..129: mol_type = other RNA; note = Related to JAGQPM010000203.1; note = Planctomycetales bacterium
cttaagtttgatgaaccttgttcatctctctggggttaccccaggggatcgcgaaggtacgacaacacgaatgtgagcgtcgatgcgtttcacgcatgattgctcacgaaagtcgagactggttaaggc

SEQ ID NO: 17826 - RNA, 145 nt, unidentified
  source 1..145: mol_type = other RNA; note = Related to JAGQPF010000096.1; note = Planctomycetales bacterium
tccaagctcggtgaagtagtgtgtttacgctgcttccctcactgggggtaccccagtgcaacttgaacaacttgccatttcagatgcgagcccgagaaatgcgcttcacgcatgactagctcgcgttgtcaggactcgttggacc

SEQ ID NO: 17827 - RNA, 139 nt, unidentified
  source 1..139: mol_type = other RNA; note = Related to CP042912.1; note = Mariniblastus fucicola
ttcaagctggatgtttcatttcgaaagatcctctgcggggttaccccgtggtttaactggacgttgcaaacgcgtttgcgtgaaagaccgggcgcctaccgacgcccctgatttcactgctggcatgacacgttgaatc

SEQ ID NO: 17828 - RNA, 151 nt, unidentified
  source 1..151: mol_type = other RNA; note = Planctomycetes bacterium; note = Related to JACRUV010000555.1
tccaagatggcaagacctctgaccgtttgcgtcagtgttttgtctctctggggataccccagggcaatgacttgacgatggacatttcgccgcgtgagccggactgcgcggaaacgcagaacagctcacgcacaacgagacgggttggaga

SEQ ID NO: 17829 - RNA, 151 nt, unidentified
  source 1..151: mol_type = other RNA; note = Related to VGYH01000867.1; note = Planctomycetes bacterium
tccaagctggtaagacgccgttccaacgacgggtccgttttgcctctctggggaaaccccaggggatccatttgaccttcacaactgcgccgcatgagcaaccgtgcgcggacgcgcacaaaggctcatgcatgacgagactggttggaga

SEQ ID NO: 17830 - RNA, 146 nt, unidentified
  source 1..146: mol_type = other RNA; note = Related to JAEUIH010000118.1; note = Planctomyces sp.
ttcaggctggcgaaacgttgccttataacaacggcttcgtctctccggggtatccccggggcaatatcttctctgtggcactgcatcgcgtgagggcaagtacgttccacgtacgattcctcacgcgaatcccgtctcgctgaacg

SEQ ID NO: 17831 - RNA, 145 nt, unidentified
  source 1..145: mol_type = other RNA; note = Planctomycetaceae bacterium; note = Related to JAGQQS010000555.1
ttcaggctggcgaatcgttgttttaaataacgacttcgtctctctggggcatccccgggggaataactgctctttggcactgcgtcgcgtgaggggtagtacgctccacgtacatttcctcacgccaatctggtttcgctgaatc

SEQ ID NO: 17832 - RNA, 142 nt, unidentified
  source 1..142: mol_type = other RNA; note = Verrucomicrobiales bacterium; note = Related to JAEUHE010000137.1
tccaagctgatgaagcggacctcggtcggccttcatctctccggggttaccccgggggaacttgtcagtagctcgtttcatcgcgagagccacgctgcgctggcgcgcagatccgctcacgcacaacgggacgcgttggagc

SEQ ID NO: 17833 - RNA, 139 nt, unidentified
  source 1..139: mol_type = other RNA; note = Related to JACPRJ010000368.1; note = Verrucomicrobia bacterium
tccaagccggtgaagttggcttgccatgcttcgcctctccggggttaccccgggggaacgcgacagtgacccgtctcatagcgagagcgtagctacgctgcgcgtaggaccgctcacgcacgacacgacgagttggagc

SEQ ID NO: 17834 - RNA, 149 nt, unidentified
  source 1..149: mol_type = other RNA; note = Related to NZ_CP042997.1; note = Aquisphaera giovannonii
tccaagcgggcggatgggtcgtcgcgaggcggcctcttcgtcgctccggggttaccccgcgagacgttggtgacgcaggcaattcggcgcgtgaggtccactacgcctccgtcgtaggtcccctcacgccggacgagtctggttggagc

SEQ ID NO: 17835 - RNA, 149 nt, unidentified
  source 1..149: mol_type = other RNA; note = Related to NZ_JAALJH010000014.1; note = Aquisphaera sp.
tccaagcgggcggatggatcgtcgcgaggcggtctcttcgtcgctccggggttaccccgcgagacgttggtgagttgggcatttcggcgcgtgaggccagctacgcctccgtcgtagagcacctcacgccggacgagactggttggagc

SEQ ID NO: 17836 - RNA, 147 nt, unidentified
  source 1..147: mol_type = other RNA; note = Related to CP003364.1; note = Singulisphaera acidiphila
cccaagcgggtgaaaccactgtcttcggatggtgggtctcacctctccggggctaccccgggggagcatcttccacggagatcgcagcgcgtgagcggccctacgcttcgcgtagaaatgctcacgcccgacgagactggttggggc

SEQ ID NO: 17837 - RNA, 139 nt, unidentified
  source 1..139: mol_type = other RNA; note = Planctomycetes bacterium; note = Related to JACKIC010000007.1
cccgggcccgggaagccaccctcgtggtgaccttctctctccggggataccccggggcatacccgcatcgccattccgctgcacggagcttcgcggcgccgcgcgccggtgggtccgcgctggaccgacacgccggggc

SEQ ID NO: 17838 - RNA, 151 nt, unidentified
  source 1..151: mol_type = other RNA; note = Verrucomicrobia bacterium; note = Related to JAFEGM010000060.1
tccgggccgaagaagcgaacgtctcctccgaggcgtgcgcctccttctctccggggctaccccgggggatatccgcattgcaaatccaccgcgcggaaggcgatgcgcctgcgtcgcatgagtttccgcgccggacccgcgtcgccggagc

SEQ ID NO: 17839 - RNA, 139 nt, unidentified
  source 1..139: mol_type = other RNA; note = Related to JAGQQE010000253.1; note = Planctomycetaceae bacterium
ctgatgcattttctgcccccaacgttgcctgaccgatcatttctccggggttaccccggggcattttcagcactcgaatttcgtcgcgtgagccatagtacgccggtcgtacaactgctcacgcctgtcaggttcagcc

SEQ ID NO: 17840 - RNA, 142 nt, unidentified
  source 1..142: mol_type = other RNA; note = Related to JAGQPY010000402.1; note = Planctomycetaceae bacterium
atcaggctgatggacggcgttcatgacgtacgattcatctctccggggctaccccggggcatattcctaaccgcgatttcgtaacgtgaggcacggtacgctgcgcgtacgattcctcacgatgctcgagtttcgctgagag

SEQ ID NO: 17841 - RNA, 135 nt, unidentified
  source 1..135: mol_type = other RNA; note = Related to NZ_JAENIJ010000042.1; note = Luteolibacter pohnpeiensis
ctcaagccggtcgtatgattcatcagcgacctctccggggttaccccgggggatcaaaagccaaaccattgcgaggcgagggcctcatcacgctagcacgtgaatatgcccacgccagacgggacacgttgaggg

SEQ ID NO: 17842 - RNA, 136 nt, unidentified
  source 1..136: mol_type = other RNA; note = Verrucomicrobiae bacterium Tous-C4TDCM; note = Related to NEUO01000019.1
gccaagccggtcgtgtggccaccatgcgacctctccggggctaccccgggggatcgacactccgaagcatcacgaggcgagggcccaatcacgctgccgcgtgagaccgcccgcgccagacaggacgcgttggcgc

SEQ ID NO: 17843 - RNA, 139 nt, unidentified
  source 1..139: mol_type = other RNA; note = Related to JAFLEF010000009.1; note = Verrucomicrobia bacterium
tccaagccggcaatgccgacctgttcgtcgttgcctctccggggttaccccgggggatctcgttaatgcctcgtcccagcgcgcgagcgtaattccgcttcacggaaatctgctcccgcccgactcgtcgcgttggagc

SEQ ID NO: 17844 - RNA, 144 nt, unidentified
  source 1..144: mol_type = other RNA; note = Related to JAHWKS010000775.1; note = Planctomycetes bacterium
tccaagccggcgttgcgtcgcatgtcgatcgccaccgtctctccgaggcttcctcgggggagttttctaccgaccgctttgcggtgcgtgagaagccttgcgccgtgcgcaaaatgtctcacgcctgactcgatgcgttggagc

SEQ ID NO: 17845 - RNA, 144 nt, unidentified
  source 1..144: mol_type = other RNA; note = Related to JABGQM010000001.1; note = Verrucomicrobia bacterium
ctcgagtttgataatgcttcgacgtgtttggagtattgtctctccggggttaccccggggtatcacgacagagagccacttcatggcacgagccttactgcaccttgtgcagctccgctcgcgcttcacaggacgggtcgagtg

SEQ ID NO: 17846 - RNA, 144 nt, unidentified
  source 1..144: mol_type = other RNA; note = Related to CP000442.1; note = Burkholderia ambifaria
gtcaagcacacccccggaacaggcagccgatgttccaggaccacggggctaccccgtggatgagaccgacactccgatgcgtcgcaagagcgcaggttgcgcgttgcgcaacgactgctctcgcagcacctgtcacgttgactc

SEQ ID NO: 17847 - RNA, 144 nt, unidentified
  source 1..144: mol_type = other RNA; note = Related to NZ_CP086299.1; note = Burkholderia ambifaria
gtcaagcacacccccggagcaggcagccgatgttccaggaccacggggctaccccgtggatgagaccgacactccgatgcgtcgcaagagcgcaggttgcgcgttgcgcaacgactgctctcgcagcacctgtcacgttgactc

SEQ ID NO: 17848 - RNA, 144 nt, unidentified
  source 1..144: mol_type = other RNA; note = Related to CABVLY010000011.1; note = Burkholderia anthina
gtcaagcacacccccggaacaggcagccgatgttccaggactacggggctaccccgtggatgagatcgacacgccgatgcgtcgcaagagcgcaatttgcgcgttgcgcaaagactgctctcgcagcacctgtcacgttgactc

SEQ ID NO: 17849 - RNA, 144 nt, unidentified
  source 1..144: mol_type = other RNA; note = Related to CP013399.1; note = Burkholderia seminalis
gtcaagcacacacccggaacaggcagtcgatgttccaggaccacggggctaccccgtggatcggatcgacacaccgatgcgtcgcaaggggcccggttgcgcgcggcgcaacgcctcccctcgcagcaccagccacgttgactc

SEQ ID NO: 17850 - RNA, 144 nt, unidentified
  source 1..144: mol_type = other RNA; note = Related to CP015035.1; note = Burkholderia cenocepacia
gtcaagcacacgcccggaacaggcagccgatgttccaggactacggggctaccccgtggatcagatcgatacgccgatgcgtcgcaagtgcgcaagttgcgcgttgcgcaacgaccgctctcgcagcaccagccacgttggctc

SEQ ID NO: 17851 - RNA, 144 nt, unidentified
  source 1..144: mol_type = other RNA; note = Related to CP011301.1; note = Burkholderia cepacia
gtcaagcacacgcccggaacaggcagtcgatgttccaggactacggggctaccccgtggatgagaccgacaccccgatgcgtcgcaagagcgcaggttgcgcgttgcgcaacgactgctctcgcagcacccgtcacgttgactc

SEQ ID NO: 17852 - RNA, 144 nt, unidentified
  source 1..144: mol_type = other RNA; note = Related to NZ_CADFDQ010000020.1; note = Burkholderia pseudomultivorans
gtcaagcacactcccggagcaggcagtcgatgttccaggactacggggctaccccgtggatcagaccgacaccccgatgcgtcgcaagagcgtgagctgcgcgttgcgcagcgcgagctctcgcaggacctgtcacgttgactc

SEQ ID NO: 17853 - RNA, 142 nt, unidentified
  source 1..142: mol_type = other RNA; note = Related to JAAGPL010000085.1; note = Burkholderia sp.
gtcaagcacaccccaggagcaggcaatcgatgttcccggactacggggctaccccgtggatgagatcgactccccgatgcgtcgcaagagcccgattgcgcgttgcgcaaagcagctctcgcagcaccgcgcacgttgactc

SEQ ID NO: 17854 - RNA, 142 nt, unidentified
  source 1..142: mol_type = other RNA; note = Related to NZ_SMRO01000001.1; note = Paraburkholderia flava
gtcaagcacacgccgggaacaggcagccgatgttccaggactacggggctaccccgtggatgaggtcgactcaccgatgcatcgcaagagccggactgcgcgctgcgcagggcggctctcgcagcaccaggcacgttgactc

SEQ ID NO: 17855 - RNA, 141 nt, unidentified
  source 1..141: mol_type = other RNA; note = Related to NZ_JACBNX010000003.1; note = Burkholderia guangdongensis
gtcaagcacaccccggaacaggcaaccgatgttcccggactacggggctaccccgtggatgagatcgactccccgatgcgtcgcaagagcccggttgcgcgttgcgcaaagccgctctcgcagcaccgagcacgttggctc

SEQ ID NO: 17856 - RNA, 143 nt, unidentified
  source 1..143: mol_type = other RNA; note = Related to CP013414.1; note = Burkholderia ubonensis
gtcaagcacacccccggagcaggcagcgcatgttccaggactacggggctaccccgtggatgagatcgactccccgatgcgtcgcaagagccgcgattgcgcgttgcgcaagacagctctcgcagcaccaggcacgttgactc

SEQ ID NO: 17857 - RNA, 140 nt, unidentified
  source 1..140: mol_type = other RNA; note = Related to VWWJ01000001.1; note = Burkholderia sp.
gtcaagcacgacccgggatcaggcagcacgctcccggacggcggggctaccccgccgatgactcgcaagtcgcaatacatcgcaagagcggcgttgcgctgacgcgcaaatgagctctcgccagactggcacgttgatcc

SEQ ID NO: 17858 - RNA, 139 nt, unidentified
  source 1..139: mol_type = other RNA; note = Related to NZ_CP046915.1; note = Paraburkholderia acidisoli
gtcaagcatgacccgggagcacgcagtgcgttccggacggcggggttaccccgccgatgactcgcaagccgtactacatcgccagcgccacgttgcgcatgcgcgcaagaacgcgctagccagactggcacgttgactc

SEQ ID NO: 17859 - RNA, 137 nt, unidentified
  source 1..137: mol_type = other RNA; note = Related to LMPF01000021.1; note = Burkholderia sp.
gtcaagcacataacgggagaatcagtgcatcccgacggtggggttaccccgccgatgactcgtaagtcgcaatacatcgcaagagcggccttgcgcatgcgcgcaacttggctctagccagactggcacgttgattc

SEQ ID NO: 17860 - RNA, 141 nt, unidentified
  source 1..141: mol_type = other RNA; note = Related to JAAGPF010000151.1; note = Burkholderia sp.
gccaagcggacctcgggagcacgcttgatcgtttcccgaacgacggggttaccccgtcgttgcaacgcacatggcaatacgtcgcaggagccttgctgcgcttcgcgcagggcagctccagccagaccggcacgttgactc

SEQ ID NO: 17861 - RNA, 142 nt, unidentified
  source 1..142: mol_type = other RNA; note = Related to NZ_MTZV01000006.1; note = Paraburkholderia acidicola
gtcaagcacaccccgggagcaggcaaccgatgttcctggactacggggttaccccgtggctgatttccagtttgcattacgtcgcaagagccagcgttgcgcgctgcgcaagatagctctcgcagaactagcgcgttgattc

SEQ ID NO: 17862 - RNA, 141 nt, unidentified
  source 1..141: mol_type = other RNA; note = Related to NZ_CADFGU010000011.1; note = Robbsia andropogonis
atcaagcttattcctcgggcgctgtcattttggcccaggaccacggggctaccccgtggatgatttggatgtcgcattgcaccgcaagagccccgttgcgcacggcgcaagcccgctctcgccacaccggtacgttgattc

SEQ ID NO: 17863 - RNA, 144 nt, unidentified
  source 1..144: mol_type = other RNA; note = Related to FNCJ01000001.1; note = Paraburkholderia phenazinium
gtcaagcttgccaaggaccgggcagtcaacgttccaggcactacggggctaccccgtggatcagcatgatctccgcagttcgtcgcatgagcccgctttgcgtgctacgcaagaccgctcacgcagcactagacgcgttgactc

SEQ ID NO: 17864 - RNA, 144 nt, unidentified
  source 1..144: mol_type = other RNA; note = Related to QVQV01000003.1; note = Paraburkholderia sp.
gtcaagcttgccggggtacgggaaggatacgttccaggcactacggggttaccccgtggatcagcatgatctccgcagttcgtcgcatgagccttctccacgccttgcgtagctgggctcacgcagcaccagtcgcgttgactc

SEQ ID NO: 17865 - RNA, 143 nt, unidentified
  source 1..143: mol_type = other RNA; note = Related to NZ_SNVI01000001.1; note = Paraburkholderia dipogonis
gtcaagcacgcctggatgctggccacataggttccgggcaccacggggctaccccgtggatcaacactactccgcagttcgtcgcatgagcctcagttgcgtcttacgcaagagcgctcacgcagcacaagacgcgttgactg

SEQ ID NO: 17866 - RNA, 143 nt, unidentified
  source 1..143: mol_type = other RNA; note = Related to FNTG01000001.1; note = Burkholderia sp.
gtcaagcacccctcgaggcaagcgacatcggttccgggcaccacgaggctaccccgtggatcaacactactccgcagttcgtcgcgtgagcctcagttgcgtgttacgcaagagcgctcacgcagcacaagacgcgttgactg

SEQ ID NO: 17867 - RNA, 144 nt, unidentified
  source 1..144: mol_type = other RNA; note = Related to NZ_QLTK01000012.1; note = Paraburkholderia bryophila
gtcaagcacgcctgagttcgggcagcatacgttccgggcactacggggctaccccgtggattagcatgacctccgcacttcgtcgcatgagcgtcacttgcgctgtgcgcaacacggctcacgcagcacaagaagcgttgactg

SEQ ID NO: 17868 - RNA, 145 nt, unidentified
  source 1..145: mol_type = other RNA; note = Related to NZ_CP024941.1; note = Paraburkholderia terricola
gtcaagcttgccccggttcgggccgcatacgttccgggcactacggggctaccccgtggatcagaatgacctccgcagttcgtcgcatgagcccgttgttgcgcgttgcgcaaatacgctcacgcagcacaagacgcgttgactg

SEQ ID NO: 17869 - RNA, 144 nt, unidentified
  source 1..144: mol_type = other RNA; note = Related to CP010026.1; note = Paraburkholderia fungorum
gtcaagcttgccagggtacaggcagtattcgttccgggcactacggggctaccccgtggattagaaagacctccgcagttcgtcgcatgagcgtgacttgcgcattgcgcaaacgagctcacgcagcacaagacgcgttgactg

SEQ ID NO: 17870 - RNA, 144 nt, unidentified
  source 1..144: mol_type = other RNA; note = Related to NZ_CAJHCR010000004.1; note = Paraburkholderia kirstenboschensis
gtcaagcttgctcaggtgcgggcagcttacgttccgggcactacggggttaccccgtggatatgaatgacctccgcagttcgtcgcatgagcctgatttgcgcgttgcgcaatgcagctcacgcagcacaagacgcgttgactg

SEQ ID NO: 17871 - RNA, 152 nt, unidentified
  source 1..152: mol_type = other RNA; note = Related to NZ_JAGKQQ010000001.1; note = Gemmata sp.
gccgagcacgatggcaacatggttcgcgagaaccgtgtccgccatcgctccggggttaccccggagaccttttatcacttgggactgcaggcgcgcgacagcccgggcgcttccacgcccccgatgtcgcgcgggacgggactcgtcgaccc

SEQ ID NO: 17872 - RNA, 152 nt, unidentified
  source 1..152: mol_type = other RNA; note = Related to NZ_LR593886.1; note = Gemmata sp.
gccgagcacggtggccgagatggttcgtaagagcccaatttgccatcgctccggggttaccccggggctttccacaacctggtactgcaagcgcgcgacagcttgggcgcttccacgcccgtcttgtcgcgcgagacaagactcgtcggccc

SEQ ID NO: 17873 - RNA, 149 nt, unidentified
  source 1..149: mol_type = other RNA; note = Related to VGZJ01000033.1; note = Planctomycetes bacterium
gccgagcacggcgggacgcgggttcgctgaaccggccgaacgccactccggggttaccccggggtgcgcccaacacgtgacagacgagcgcgcgacgaactgggcgcttccacgcccgccccgtcgcgccggccgagactcgtcggccc

SEQ ID NO: 17874 - RNA, 151 nt, unidentified
  source 1..151: mol_type = other RNA; note = Related to PNKH01000003.1; note = Isosphaera sp.
cccgagcacgccgccgtcgtgtccgcaggggcgcaacgggccggcacgccggggttaccccggtggtcgcacaccacctgtcccagccagcgcgcgacagactgggcactaccgtgcccgccgtgtcgcgccggacgagactcgtcgggcc

SEQ ID NO: 17875 - RNA, 150 nt, unidentified
  source 1..150: mol_type = other RNA; note = Related to JAFKFQ010000274.1; note = unidentified bacterium
cccgagtctcgtcgtccgttggtccgcaagaatcgacggccggcacgccggggttaccccggcgcaggttcgtaacccgagtcggttggcgcgcgacggcgggggcactcccatgcccgtcccgtcgcgccggacaggaccggtcgggtc

SEQ ID NO: 17876 - RNA, 150 nt, unidentified
  source 1..150: mol_type = other RNA; note = Related to JAIEQO010001050.1; note = Gemmataceae bacterium
cccaagcccggcaggcgctccgcccgcgagggcggggcggttgctgccccggggataccccgggggcctttcctcacttgagccgctcggcgcgcgacggcgggggcgctccacgcccgacccgtcgcgccggaccggactcgttggggc

SEQ ID NO: 17877 - RNA, 150 nt, unidentified
  source 1..150: mol_type = other RNA; note = Related to JAFATI010001257.1; note = Planctomycetes bacterium
ctcaagacgacgataccgttgttgcctcaacagcggttagggtctcttcggggctaccccgggggagcggtttcgttaccacaggacgccgcgcgaccttccctgcgctaccacgcagcccaggtcgcgcttcacgagttaggttgggac

SEQ ID NO: 17878 - RNA, 143 nt, unidentified
  source 1..143: mol_type = other RNA; note = Related to JACPPF010000025.1; note = Planctomycetes bacterium
ttcaagaagacgccaggctgtttcggcagcgtgggtgtctgtgcggggctaccccgcgcgtgcgacaatcccgagcgttccagcgcgcggcctcggcctgcgcttcacgcagataaggccgcgcgagacgagaaggttgaatg

SEQ ID NO: 17879 - RNA, 137 nt, unidentified
  source 1..137: mol_type = other RNA; note = Related to NZ_CP011125.1; note = Sandaracinus amylolyticus
gtcgagccgatcgaggcgcacgcctcggtctccgcgaggcttcctcgcggacgcttcgtacctccagcatcgacgtcgcacgtgccccggctgcggaaccgcagcgaccgcacgcgcaggaccggaatcgtcgacgc

SEQ ID NO: 17880 - RNA, 146 nt, unidentified
  source 1..146: mol_type = other RNA; note = Deltaproteobacteria bacterium; note = Related to JACPFM010000079.1
accaagacggtggcgagtggtcttcggatcgcgcgccgcctctccggggcaaccccgggggtgctccttcagccacgcagggcaacgcgtgacccacgctgcgcgctggcgcaggactggtcacgcacgacgagatcggttggccg

SEQ ID NO: 17881 - RNA, 140 nt, unidentified
  source 1..140: mol_type = other RNA; note = Related to JABFXX010000467.1; note = Kofleriaceae bacterium
accaagcaggtgatcggccactggttggtcacctctccgcggtaaccgcggggatgctgtacgagtacgagagtgcgatgcacgcgatcgggctgcgcgaaacgcaggtcctcgcgtggcgagacgagactggttggtac

SEQ ID NO: 17882 - RNA, 127 nt, unidentified
  source 1..127: mol_type = other RNA; note = Myxococcales bacterium; note = Related to JADJMO010000033.1
accaagcaggcggactccgcctctccggggcaaccccggggacgatccatcaccgaacacggccacggcccgacgggcggcgcgcggttgcgcgcgattcgtcgcgcaggacgagcaccgttggtct

SEQ ID NO: 17883 - RNA, 126 nt, unidentified
  source 1..126: mol_type = other RNA; note = Myxococcales bacterium; note = Related to JAGQJB010000072.1
tccgagccggtgatcgctcaccgcttcggggctaccccgagggcacttcgtcaggtaccgatccagcgcccggcccgggctgcgcgatacgcagggctggccgggccagaccagtcacgtcggagc

SEQ ID NO: 17884 - RNA, 148 nt, unidentified
  source 1..148: mol_type = other RNA; note = Related to JADJOY010000023.1; note = Deltaproteobacteria bacterium
ctcgagccggtagccagcgctttcgagcacgaggcgcctccgcggggataccccgcgggaagattcacagctgaccattccatcgcacggaggtccgtgcgcgccctggcgcgcactcgtctccgcgcaccacgggcctcgtcgaggg

SEQ ID NO: 17885 - RNA, 144 nt, unidentified
  source 1..144: mol_type = other RNA; note = Related to JAHBWB010000013.1; note = Labilithrix sp.
tccaagccggcaacggttcgcctcgcgcggacctcagcctctccgaggttacctcgggggacgttcgtaagtgtggttctcagcgcgtgagacacggggcgccaggacgcccgacctctcccgcatcacgggtctcgttggagc

SEQ ID NO: 17886 - RNA, 145 nt, unidentified
  source 1..145: mol_type = other RNA; note = Related to MKVQ01000030.1; note = Myxococcales bacterium 68-20
ttcaagccggcatggccttcgcctcgcgcgaagctctgcctctccgaggctacctcgggggatgttcgtgagtatggctctcagcgcaagacgcgcggggcgccaagacgcccgacacgtcgtgcaacacgggtctcgttggagt

SEQ ID NO: 17887 - RNA, 132 nt, unidentified
  source 1..132: mol_type = other RNA; note = Polyangiaceae bacterium; note = Related to JABFRG010000265.1
ttcggggcgagcgcggtgccgagccgcttcggggtgaaccccgaggacgacgacgtggatacacagcgcatcgcgcgagggagagtgcggacgaccgcacgacctctcgcgccggacgagaccggttgatgc

SEQ ID NO: 17888 - RNA, 154 nt, unidentified
  source 1..154: mol_type = other RNA; note = Related to JAHBWD010000001.1; note = Labilithrix sp.
gtcgagtgggaagagcgcttctccgatctcggatcggtaggcgcgaatcctcgccggggttaccccggcgcacgcgtacgatcgagcattgcagcgcatgaggcacggtccgccagacggacgacccctcacgcaagacgagacaggtcgacgc

SEQ ID NO: 17889 - RNA, 146 nt, unidentified
  source 1..146: mol_type = other RNA; note = Related to JAGQIZ010000167.1; note = Myxococcales bacterium
cccgagcccttgggctcatccctcgtggattgggctgtcgctctccggggttaccccggggaaacgtcatgactttggcattcgtctcgcgaggaacggcccgcgttcacgggcgacccctcgctagggaccagacacgtcgagcg

SEQ ID NO: 17890 - RNA, 140 nt, unidentified
  source 1..140: mol_type = other RNA; note = Deltaproteobacteria bacterium; note = Related to JACQYO010000099.1
tccgagcttgcggtgcgggtctacgcatcggctctccggggctaccccggggaattcttgagactaggcaactcagcgcgcgagcttcgctgcatccctaatgcaggactgctcgcgcctcgacgagatcacgtcggggc

SEQ ID NO: 17891 - RNA, 127 nt, unidentified
  source 1..127: mol_type = other RNA; note = Deltaproteobacteria bacterium; note = Related to BJHF01000062.1
gccgagccggtgagcttcaccactccggggaaaccccggggatccctcgttaccttgggcacccgtcgcaggaccctgagtgcgcattcacgcacgtctggtcctgcccgacggggcgcgtcgggcg

SEQ ID NO: 17892 - RNA, 146 nt, unidentified
  source 1..146: mol_type = other RNA; note = Related to JADZFZ010000151.1; note = Deltaproteobacteria bacterium
cccgagcaggtgttcgttcgccggagacggcgagcgcacctcttcggggtcaccccgaggacacgaccacggcagaaggctccatcgcacgagcggagccgcgccacgacgcggagctgctcgcgcttcacgagaatcgtcgggac

SEQ ID NO: 17893 - RNA, 147 nt, unidentified
  source 1..147: mol_type = other RNA; note = Related to NZ_RAWM01000011.1; note = Corallococcus interemptor
acccagcaggtagacggtccgtggcgacacggtcccctgcctctccggggtacccccggggattcttcaagcggagcacttccccacgcatggccgacctcgcggcaagccgcgacgctggccacgccagacgggacaggtgggacc

SEQ ID NO: 17894 - RNA, 147 nt, unidentified
  source 1..147: mol_type = other RNA; note = Related to NZ_CP079946.1; note = Corallococcus sp.
acccagcaggtagcaggtccgtggagacacggtcccctgcctctccggggtacccccggggaatccatacacggagcacttccccacgcgtggccgaccccgcggcaagccgcgaccctggccacgccagacgggacaggtgggacc

SEQ ID NO: 17895 - RNA, 147 nt, unidentified
  source 1..147: mol_type = other RNA; note = Related to NZ_VIFM01000112.1; note = Myxococcus sp.
acccagcgggtagacggtccgtggtgacacggtccgctgcctctccggggtacccccggggaatgatttcgaggagcacagccccacgcgaggccgggactgcggcgagccgcagtgcgggccacgccagacgggacaggtgggtcc

SEQ ID NO: 17896 - RNA, 147 nt, unidentified
  source 1..147: mol_type = other RNA; note = Related to NZ_CP071091.1; note = Myxococcus sp.
acccagcgcgtagacggaccgtggagacacggcccgctacttctccggggtacccccggggagtcttctcgaggagcacatccccacgcgaggccgggtccgcggcaagccgcgactcgggccacgccagacggggcaggtgggcgc

SEQ ID NO: 17897 - RNA, 147 nt, unidentified
  source 1..147: mol_type = other RNA; note = Related to NZ_FOIB01000009.1; note = Myxococcus fulvus
acccagcgcgtagacggtccgtggtgacacggccttctgcttctccggggtacccccggggagtcgtcatgaggaacacactcccacgcgaggccggtatcgcggcgagccgcgactctggccacgccagacgggacaggtgggccc

SEQ ID NO: 17898 - RNA, 146 nt, unidentified
  source 1..146: mol_type = other RNA; note = Related to NZ_JAAIYA010000009.1; note = Pyxidicoccus sp.
ctcaaggggtgacgcagtcgtcttcgggcggcgcgttccctctccggggctaccccggggatgccgtgggacgtcggacttcacagcacatgcccggtagtgcgcgttgcgcaccgcggggcacgtaggacaggacaggatggggc

SEQ ID NO: 17899 - RNA, 148 nt, unidentified
  source 1..148: mol_type = other RNA; note = Related to JADYYK010000281.1; note = Deltaproteobacteria bacterium
cgcgagctggggaggtcgccatcgcgagatggagaccgaacctctccggggttcccccggggcaacttcgcggacagggcaagacggcgcgtgaccctcgctgcgcttcacgcagatccggtcgacgcaggacgagatcggtcgcgag

SEQ ID NO: 17900 - RNA, 132 nt, unidentified
  source 1..132: mol_type = other RNA; note = Related to DOEP01000754.1; note = Planctomycetes bacterium
ctcgagttcgctcggaacgatccgggactctggggttaccccaggggcagagtgttgactcaagaacgccaactcacgacggcccgtgcgcttgcacgcaccggtcgtcgcgtggggtgagacggtcggggc

SEQ ID NO: 17901 - RNA, 139 nt, unidentified
  source 1..139: mol_type = other RNA; note = Planctomycetes bacterium; note = Related to JAHBXY010000029.1
cccaagacggtccgtggtcctcggacgacggacgctccggggataccccggggcctgaccatgacgaacacgtgtcgacgcatggcctccggtgcgacgggtcgcacgaccggccacgccggacgcgacaggttggggc

SEQ ID NO: 17902 - RNA, 144 nt, unidentified
  source 1..144: mol_type = other RNA; note = Related to JAJTCO010000005.1; note = Pseudoduganella sp.
ttcaagccggcctgtcttttgcctcgcgcagggacagcctctacggggctaccccgtgggatgctttttgttccgcacttcgccgcatgagcggcattgcgctggcgcgcaaccatgctcacgcatcacgagactcgttgaagg

SEQ ID NO: 17903 - RNA, 144 nt, unidentified
  source 1..144: mol_type = other RNA; note = Related to NZ_LMDJ01000008.1; note = Massilia sp.
ttcaagccggcctgtccctgcttcgtgcagggacagcctctacggggctaccccgtggtaacttgattggttcagcatttcgccgcatgggcctggttgcgctttcgcgcaaagccgctcacgcatcacgagactcgttgaagg

SEQ ID NO: 17904 - RNA, 143 nt, unidentified
  source 1..143: mol_type = other RNA; note = Related to NZ_CP086370.1; note = Massilia sp.
ttcaagccggcctgtcactgcctcgtgcagggacagcctctacggggctaccccgtgggacattgattgttcagtacttcgccgcctgggccgcgttgcgcttccgcgcaagacagcccacgcatcacgagactcgttgaagg

SEQ ID NO: 17905 - RNA, 142 nt, unidentified
  source 1..142: mol_type = other RNA; note = Related to NZ_AUDI01000016.1; note = Pseudoduganella violaceinigra
ttcaagccggcctgtccttgcctcgcgcagtgacagcctctacggggctaccccgtgggatattttttgctcagcatttcgccgcatgagagtccttgcgctccgcgcaacgaaactcaagcatcacgagactcgttgaagg

SEQ ID NO: 17906 - RNA, 142 nt, unidentified
  source 1..142: mol_type = other RNA; note = Related to NZ_WNKX01000014.1; note = Massilia eburnea
ttcaagccggcctgtccctgccgcgtgcagggcacgcctctgcggggctaccccgtgggatgttgattgatctgcatttcgccgcatgagcgccattgcgttccacgcaaacatgctcacgcatcacgagactcgttgaagg

SEQ ID NO: 17907 - RNA, 142 nt, unidentified
  source 1..142: mol_type = other RNA; note = Related to LMDB01000012.1; note = Duganella sp.
gccaagccggcctgtctttgcttcgtgcagggacagcctctgcggggttaccccgcgggatgtttgatgttctgcatttcgccgcatgagtggcattgcgcttcgcgcaaccatacgcacgcttcacgagactcgttggcgg

SEQ ID NO: 17908 - RNA, 143 nt, unidentified
  source 1..143: mol_type = other RNA; note = Related to CP051684.1; note = Duganella sp.
ttcaagccggcctgttcttgccgcgtgcaggaacagcctctgcggggttaccccgtgggatatttattgttcagcacttcaccgcctgagccccgttgcgctagcgcgcaagatagctcacgcatcacgagactcgttgaagg

SEQ ID NO: 17909 - RNA, 143 nt, unidentified
  source 1..143: mol_type = other RNA; note = Related to NZ_WKJN01000036.1; note = Duganella alba
ttcaagccggcctgttcttgccgcgtgcagggacagcctctgcggggctaccccgtgggatattgattgttcagcacttcgccgcctgagccgcgttgcgctcccgcgcaagacagctcacgcatcacgagactcgttgaaag

SEQ ID NO: 17910 - RNA, 143 nt, unidentified
  source 1..143: mol_type = other RNA; note = Related to WHUF01000005.1; note = Rugamonas rivuli
ttcaagccggtctgtctttgcctcgtgcagggacagcctctacggggctaccccgtgggatgtttaatgttcagcacttcgccgcatgagccgcgttgcgtttccacgcaagactgctcacgcatcacgagactcgttgaagg

SEQ ID NO: 17911 - RNA, 142 nt, unidentified
  source 1..142: mol_type = other RNA; note = Related to QVIN01000001.1; note = Duganella sp.
ttcaagccggcctgtctttgcttcggcagggacagcctctacggggctaccccgtgggatgtttaatgttcagcacttcgccgcatgagcgccgttgcgctaccgcgcaagacagctcacgcatcacgagactcgttgaagg

SEQ ID NO: 17912 - RNA, 143 nt, unidentified
  source 1..143: mol_type = other RNA; note = Related to QVIO01000002.1; note = Duganella sp.
ttcaagccggcctgtctttgccgcgtgcagggacagcctctacggggctaccccgtgggatgtttaatgttcagcacttcgccgcatgagccgcgttgcgttaccacgcaagttagctcacgcatcacgagactcgttgaagg

SEQ ID NO: 17913 - RNA, 143 nt, unidentified
  source 1..143: mol_type = other RNA; note = Related to NZ_WWCJ01000021.1; note = Massilia guangdongensis
tccaagccggcctgttcttgccttgtgcatggacagcctctgcggggctaccccgcgggatattgaaggtcctgctttacgccgcatgagcgtctttgcgctaccgcgcaactctgctcacgcatcacgagactcgttgaagg

SEQ ID NO: 17914 - RNA, 144 nt, unidentified
  source 1..144: mol_type = other RNA; note = Bdellovibrionales bacterium; note = Related to JACMNR010000433.1
ttcaagccggcacgactttaccctgtgtaaagaattgcctccgcggggttaccccacgggatattcattgcttcgcatttcaccgcatgagcgaccgtgcacaaaaacgcaccttggctcacgcatcacgagactcgttgaagg

SEQ ID NO: 17915 - RNA, 144 nt, unidentified
  source 1..144: mol_type = other RNA; note = Related to WHJH01000043.1; note = Massilia mucilaginosa
ttcaagccggcctgttcttgcctggtgcagggacatgcctctgcggggctaccccgtgggaactatattgctgtgcaattcaccgcatgagccgccgtgcgctgccgcgcacttaagctcaagcttcacgagactggttgaagg

SEQ ID NO: 17916 - RNA, 141 nt, unidentified
  source 1..141: mol_type = other RNA; note = Related to FQWU01000004.1; note = Massilia sp.
ttcaagcagacaggctttcgtcttgtaaaaggcgagtctccatggggttaccccatgaaatttttaatgttttgcatttcatcgcaagagattctgtgtgcttcgcacacgggcactcgagcgtcacaagtacgttgaagg

SEQ ID NO: 17917 - RNA, 143 nt, unidentified
  source 1..143: mol_type = other RNA; note = Related to NZ_CP013232.1; note = Collimonas fungivorans
ttcaagccggcgcgctgttacctcgtgtaatggaacgcctctgcggggctaccccgcgggatattttggcttggcaatgcaacgcatgagcggcgctgcaccacggtgcagatatgctcacgcatgacgggactggttgaagg

SEQ ID NO: 17918 - RNA, 144 nt, unidentified
  source 1..144: mol_type = other RNA; note = Related to FOLC01000015.1; note = Collimonas sp.
ttcaagccggcgcactgttaccttgtgtaatgggacgcctctgcggggttaccccgcgggatattttggctgggcaatgcaacgcatgagcggccctgcaccacggtgcaggctcggctcacgcatgacgggactggttgaagg

SEQ ID NO: 17919 - RNA, 143 nt, unidentified
  source 1..143: mol_type = other RNA; note = Related to PDBX01000001.1; note = Collimonas sp.
ttcaagtcggcgtgctgttacctggtgtagcggagcgcctctgcggggctaccccgtgggatattttggcttggcaatgcagcgcatgagcggcgctgcaccctgatgcaggtttgctcatgcatgacgggactggttgaagg

SEQ ID NO: 17920 - RNA, 143 nt, unidentified
  source 1..143: mol_type = other RNA; note = Burkholderiales bacterium; note = Related to JACOUL010000024.1
ttcaagtcggcgcgatgtcacctcgtgtgatgaaacgcctctgcagggctaccctgcgggacatttttgattgggcaatgcaacgcatgagccgaactgcacgctgtgcaggactgctcatgcataacaagactggttgaagg

SEQ ID NO: 17921 - RNA, 138 nt, unidentified
  source 1..138: mol_type = other RNA; note = Related to NZ_QJKB01000006.1; note = Undibacterium pigrum
tgcaagctggcgctcagacgcaagtccatagtgcctctgcggggttaccccgcgggataaatttacctggtatttcatcgcgtgagccgccctgcacttcatgcagattggctcacacttgacgagactggttgcagg

SEQ ID NO: 17922 - RNA, 150 nt, unidentified
  source 1..150: mol_type = other RNA; note = Related to JAKZHX010000011.1; note = Undibacterium sp.
ttcaagcctggtgcacagatgcagttcaccgcaaatcaaatgcacctctgcggggttaccccgcaggacagacagacctggtatttcatcgcgtgagccgccttgcactgacgtgcaaacaggctcacacttcacaagactggttgaagg

SEQ ID NO: 17923 - RNA, 144 nt, unidentified
  source 1..144: mol_type = other RNA; note = Related to JAGOHT010000005.1; note = Alphaproteobacteria bacterium
tgcaagcttggccggtgtttttgcatccaaagacaccgccgctccggggttaccccggggacttattttaaggcaccaatacagcccatgagcgaccctgcacgttgtgcagcgcagctcatggcagacgagactggttgcaca

SEQ ID NO: 17924 - RNA, 148 nt, unidentified
  source 1..148: mol_type = other RNA; note = Related to NZ_JONR01000045.1; note = Nevskia soli
ttcaagctggcaggcaagtcctctgtacgtagacttcttgcctctccggggttaccccggggttggttcctgatggtggcaaaatcgtcccacgagcgggtctgcacgaggtgcagtgcggctcgtggacaacgcgactggttggaga

SEQ ID NO: 17925 - RNA, 156 nt, unidentified
  source 1..156: mol_type = other RNA; note = Betaproteobacteria bacterium; note = Related to JAEUMY010000023.1
tccaagcggatggtgattgcgtaggtttccttttcgcagtcatatctctccggggataccccggggttcttgatgtacccaggcaattcgtctcatgagccgcgttgcacgacaagcgcgcaaagatggctcatgaatgactcgacaggttggagc

SEQ ID NO: 17926 - RNA, 143 nt, unidentified
  source 1..143: mol_type = other RNA; note = Related to NATR01000129.1; note = gamma proteobacterium symbiont of Ctena orbiculata
tccgagcggttccacgagatttgcacgcaaacccgtggaagactccggggttaccccggggtggcgttatagctgacatttcattgccggtacggcactgcgcttcacgcagtgttgtacaggcccgacgagcaggtcggagg

SEQ ID NO: 17927 - RNA, 146 nt, unidentified
  source 1..146: mol_type = other RNA; note = Candidatus Thiodiazotropha endolucinida; note = Related to NZ_MARB01000009.1
tccgagcagttccgcgactatggcacgccaaggtcgccggacactccggggctaccccggggtagcgttatagccaacatttccgttgctggtaccacgttgcgcttcacgcaagagggtaccagccatacgagcagggtcggagg

SEQ ID NO: 17928 - RNA, 149 nt, unidentified
  source 1..149: mol_type = other RNA; note = Gammaproteobacteria bacterium; note = Related to JAGRGZ010000050.1
ttcgagcggttccatggcctggcgatgccggggttctggaacgctccggggttaccccggggatgcctggttcagtctgacaatgcattgccggtacaccactgcgctgcacgcagatgctgtaccggcgggacgagagtggtcgaagg

SEQ ID NO: 17929 - RNA, 148 nt, unidentified
  source 1..148: mol_type = other RNA; note = Related to JAGRGX010000033.1; note = Gammaproteobacteria bacterium
tccgagtattacccagagcgtcgtcttggcgatgtccgcgggtgctccggggaaaccccggggttctgatttcactcgcacactgcgtggccggtacgtcactgcacgtcgtgcagaaacgcaccggcacaaccggcatggtcggagg

SEQ ID NO: 17930 - RNA, 149 nt, unidentified
  source 1..149: mol_type = other RNA; note = Gammaproteobacteria bacterium; note = Related to JAGRGY010000021.1
tccgagctcaccccggttcccgccatcggcgtggccgcgggcgctccggggaaaccccgggggacgtctcgtctaccgacacatctcgccgccggtacgtcgctgcacggcgtgcagacacgtaccggcccgacaggcctcgtcggagg

SEQ ID NO: 17931 - RNA, 146 nt, unidentified
  source 1..146: mol_type = other RNA; note = Alphaproteobacteria bacterium; note = Related to SCTB01000034.1
ttcgagatattccgcgttcaacttcggttggattgaggaattctccggggttaccccggggaagagtttttccgaggacatttcgtgtccggtgcgtccctgcacgttgtgcagcacggcaccggaaataccagaattgtcgaagg

SEQ ID NO: 17932 - RNA, 150 nt, unidentified
  source 1..150: mol_type = other RNA; note = Related to WGNE01000059.1; note = Alphaproteobacteria bacterium
tccgagacgttcctgattttgacttttgttgaacgaaggaactctccggggttaccccggggaatggtttttgcctggacatatcatgtccggtgcgtccctgcgcctttacgcgcagcgcggcaccggaaacacgagaagcgtcggagg

SEQ ID NO: 17933 - RNA, 145 nt, unidentified
  source 1..145: mol_type = other RNA; note = Pseudomonadales bacterium; note = Related to PBDO01000002.1
tccgagcgtttcatcacggggcttggccccagggtgaaagctccggggttaccccgggggcgattcaacagtaagaacacaccgtagttggtacggcgcttcgctgcacgcagtaccgtactgaatggaccagactggtcggaga

SEQ ID NO: 17934 - RNA, 130 nt, unidentified
  source 1..130: mol_type = other RNA; note = Related to NZ_AONC01000057.1; note = Imhoffiella purpurea
cccgaggcggccgcgatcggcggcctctccggggctaccccgggggagatccccaaccaggcattccgacgcacgtgcgtccctgcgctccgcgcagggctgcacgcgcctccacgagacgggtcggggc

SEQ ID NO: 17935 - RNA, 130 nt, unidentified
  source 1..130: mol_type = other RNA; note = Related to JAAIJQ010000073.1; note = Thiorhodococcus minor
cccgaggtggccagcatcatcggcctctccggggctaccccgggggcgattcccaaccaggcagtccagtgcacgggcgaccctgcgctccacgcagggctgcccgcgcgcccacgagacgggtcggggc

SEQ ID NO: 17936 - RNA, 146 nt, unidentified
  source 1..146: mol_type = other RNA; note = Gammaproteobacteria bacterium; note = Related to JAGRGW010000386.1
tccgagattgcccgtactcaccgccatgaggcgtgttcgggcactccggggataccccggggttattttccatacaagcaacacagcgcacggacggcgctgcgccttgcgcagctttgtccgcgcaaagagagcagggtcggagt

SEQ ID NO: 17937 - RNA, 135 nt, unidentified
  source 1..135: mol_type = other RNA; note = Related to LUKZ01000009.1; note = Acidovorax sp.
gccaagcatgtcgagcctgcacaggttcgggccatggggcagccccacggtgttctcctcatacgcccacattggggcgcgcgaaccagccgccaccggtggcaaacagttcgcgcccaacccgctggttggtac

SEQ ID NO: 17938 - RNA, 135 nt, unidentified
  source 1..135: mol_type = other RNA; note = Related to NZ_NOIG01000002.1; note = Acidovorax kalamii
gccaagcatgtcgagcctgcacaggttcgggccgtggggcagccccacggtgttctcctcatacgcgcacattggggcgcgcgaaccagccgccaccggtggcaaacagttcgcgcccaacccgctggttggtac

SEQ ID NO: 17939 - RNA, 138 nt, unidentified
  source 1..138: mol_type = other RNA; note = Related to NZ_CP035951.1; note = Acidovorax sp.
gccaagcacttcgagcctgttgatcaggatcgagccgtggggcagccccacggtgttgtcttccaacgcgtccatcgcggcgcgcgaacctcccgccacccgtggcgtgcagttcgcacccaacccgcaggttggcac

SEQ ID NO: 17940 - RNA, 138 nt, unidentified
  source 1..138: mol_type = other RNA; note = Related to NZ_AFBG01000026.1; note = Acidovorax radicis
gccaagcatttcgagcctgttcatcaggttcgagccgtggggcagccccacggtgttgtcttccaaagcgtccatcgcggcgcacgaacgtcacgccacccgtggcgcgatgttcgcgcccaacccgccggttggcac

SEQ ID NO: 17941 - RNA, 135 nt, unidentified
  source 1..135: mol_type = other RNA; note = Related to JAHUWH010000023.1; note = Acidovorax sp.
gccaagcatctcgaactctcaccggttcgaaccgtggggtagccccacggtgtctcactgcaagcgcccattgtggcgcgcgaacctccaagccatcctggcaagcgtgttcgcgcccaacccgccggttggtgc

SEQ ID NO: 17942 - RNA, 133 nt, unidentified
  source 1..133: mol_type = other RNA; note = Related to AKJX01000004.1; note = Acidovorax sp.
gccaagcattctgaaccactgaaggttcgggccgtggggtagccccacggtgtatccgacaagcacgcttcgcggcgcgcgaaccacccgccacccgtggcgcccagttcgcgcccgacccgcaggttggtgc

SEQ ID NO: 17943 - RNA, 133 nt, unidentified
  source 1..133: mol_type = other RNA; note = Related to JACHLK010000020.1; note = Acidovorax soli
gccaagcattccgaccccttaccggttcgggccgtggggtagccccacggtgtatctggcaagcgcacatcgcggcgcgcgaacctcctgccatccgtggcaccaggttcgcgcccaacccgcaggttggcgc

SEQ ID NO: 17944 - RNA, 133 nt, unidentified
  source 1..133: mol_type = other RNA; note = Related to JAFKGX010000054.1; note = Comamonadaceae bacterium
gccaagcattccgagcctgtcagggttcgggccgtggggcagccccacggtattcctcgcaagcgcacatcggggcgcgcgaaccgcacgccacccgtggcgacccgttcgcgcacgacctgccggttggcgc

SEQ ID NO: 17945 - RNA, 158 nt, unidentified
  source 1..158: mol_type = other RNA; note = Related to JAGOEM010000124.1; note = Ottowia sp.
accaagcctttcgagtgttgattgggtctgcttcggcaggtacaggaaaagctcgggctgtggggcttccccacggtcaacctccagcgtgacattgcggcgcacgaacgccactcctgctcaggagccctgttcgtgcacaacccgcacgttggctg

SEQ ID NO: 17946 - RNA, 168 nt, unidentified
  source 1..168: mol_type = other RNA; note = Related to NZ_JADKYZ010000005.1; note = Diaphorobacter sp.
gccaagcgttgccgcattggctccacccgcgttcatgcaacgcatgtggtttcgtcaatacgggccgtggggcatccccatggttgctttcaaaatggacttcaccgggcgcgaacttcccgcggattcatctcgcaacctgttcgcgcaagacctgcaggttggcag

SEQ ID NO: 17947 - RNA, 138 nt, unidentified
  source 1..138: mol_type = other RNA; note = Burkholderiales bacterium; note = Related to RDZW01000120.1
gtcaagattgctgattcgtctgcaatcctggcgctccggggcatccccggggttattggataggtgtgcatttcggtgcatgagcccgacctgcgctttcagcgcagatcagctaatgcgagaccggttggttgaagc

SEQ ID NO: 17948 - RNA, 141 nt, unidentified
  source 1..141: mol_type = other RNA; note = Related to NZ_BCWR01000006.1; note = Hydrogenophaga taeniospiralis
ttcaagatctctcgaagacgctggtcgttttcgggctgtggggcatccccacggcgacgatgctttcctggacacacggcgcgcgatcccgacctgcgccgctggcgcaggacagatagcgccagacctgctggttgaagc

SEQ ID NO: 17949 - RNA, 140 nt, unidentified
  source 1..140: mol_type = other RNA; note = Betaproteobacteria bacterium HGW-Betaproteobacteria-15; note = Related to PHCR01000005.1
ttcaagatccctcgaagacgctggtcgttttcgggctgtggggtatccccacggcgacgatggtttcctggacacacgacgcgcgatccgcgctgcgccgctggcgcagaccagatagcgctggacctgctggttgaggc

SEQ ID NO: 17950 - RNA, 141 nt, unidentified
  source 1..141: mol_type = other RNA; note = Related to NZ_CP063400.1; note = Hydrogenophaga sp.
ttcaagaaccctcgaagacgctcgacgttttcgggctgtggggcatccccacggcgacacacgattccctggacacacgacgcgcgatccgcgctgcgccgctggcgcaggacagatcgcaccggaccggctggttggaac

SEQ ID NO: 17951 - RNA, 140 nt, unidentified
  source 1..140: mol_type = other RNA; note = Related to NZ_BCTF01000032.1; note = Hydrogenophaga flava
gccaagcgcaatcgaaagcctcttggttttcgggctgtggggcatccccatggcaacgtctgatggttggcacacacggcgcgcgatccgcgctgcgccgctggcgcaggacagatcgcacccgaccggctggttggcgc

SEQ ID NO: 17952 - RNA, 144 nt, unidentified
  source 1..144: mol_type = other RNA; note = Related to NZ_CP071796.1; note = Ottowia testudinis
ttcaagaaccatcgagaacgcgtttttgcgtttttcgggccgtggggcatccccacggcaagttatcttgtgtgcgcattccggcgcgcgatcggccttgcgctgccacgcaaacatgatcgcgcacgaccggctggttgaagc

SEQ ID NO: 17953 - RNA, 135 nt, unidentified
  source 1..135: mol_type = other RNA; note = Related to NZ_CP011514.1; note = Mitsuaria sp.
gccaagccttcggaagcgttcgcgcctccggccgcggggcatccccgcggcgctcttcttcgttagtcatccggcgccgataccgagccacgctgccgcgcggacctgtatcggtcgagaccggccagttggcgg

SEQ ID NO: 17954 - RNA, 134 nt, unidentified
  source 1..134: mol_type = other RNA; note = Related to NZ_BCYP01000018.1; note = Mitsuaria chitosanitabida
gccaagctttcggaagcgcttgcgcctccggccgcggggcatccccgcggcgctctcgttggacagccatccggcgccggttcggcaccgcgctcgcgcgcggagatgaacccgcgagaccggtgagttggcgg

SEQ ID NO: 17955 - RNA, 134 nt, unidentified
  source 1..134: mol_type = other RNA; note = Related to CP013729.1; note = Roseateles depolymerans
gccaagcctgtcggaggctctggcttccgggccgcggggcatccccgtggcatcgcattgagtgacgcattccggcgcgagatccgccttgcgcttcgcgcaacacagaactcgcaggaccggctcgttggcag

SEQ ID NO: 17956 - RNA, 134 nt, unidentified
  source 1..134: mol_type = other RNA; note = Related to JACHXO010000004.1; note = Roseateles terrae
gccaagcatgtcgaaggcttcggctttcgggccgcggggcatccccgtggcatttttcagagtgaggcattccggcgcgccttcggcaatgcgctgcgcgcatcggagaaatcgcaggaccggctcgttggtgg

SEQ ID NO: 17957 - RNA, 135 nt, unidentified
  source 1..135: mol_type = other RNA; note = Related to FOAV01000002.1; note = Roseateles sp.
gccaagcatgtcggaggctcacgcttccgggccccggggaatccccggggcatcgtccatagtgattcattccggcgcgagttccgacgtgcgctccgcgcattccagaacatcgccagaccggccggttggtgg

SEQ ID NO: 17958 - RNA, 136 nt, unidentified
  source 1..136: mol_type = other RNA; note = Related to JACORT010000001.1; note = Ramlibacter sp.
ttcaagcattcaccggtaccggaaggtcccgggccgtggggcatccccacggcatcccttcgaagctgccatcacgttgcggaatggccgttgcgcgctgcgcaagacgcatgccgcagcacccgctggttggggc

SEQ ID NO: 17959 - RNA, 136 nt, unidentified
  source 1..136: mol_type = other RNA; note = Related to RKMB01000020.1; note = Ramlibacter sp.
ttcaagcatcatcgagggtgaaagaccttcgggccgtggggcatccccacggcatctcttgaagttggcattacggcgcgtgatgcgcactgcgcgaaaacgcaggagtcatcacgcctgacccgctggttggagt

SEQ ID NO: 17960 - RNA, 136 nt, unidentified
  source 1..136: mol_type = other RNA; note = Related to JAHBZO010000019.1; note = Ramlibacter sp.
ttcaagcattaccgaggtttaaaagcctcgggctacggggtatccccatagcaatagttctagcaagcatttcggcgcgtgatgccaactgcgactgcgtcgcagcgcacatctcgcttgaccggctggttgaggg

SEQ ID NO: 17961 - RNA, 151 nt, unidentified
  source 1..151: mol_type = other RNA; note = Related to NZ_JABRWJ010000001.1; note = Aquabacterium terrae
cccaagtcttgccgaggctcaccgaccccgtgcggtggtttcgggccgcggggtttccccgcggcaggttccagcactcgatcttttcggcgcgtgaccggacctgcgctgacgcgcagacctggtcgcgcatcacctgctcagttgggaa

SEQ ID NO: 17962 - RNA, 147 nt, unidentified
  source 1..147: mol_type = other RNA; note = Related to NZ_CP045644.1; note = Variovorax paradoxus
ttcaagactcgacaaggtgatgcgattcgtcgtttgaccttgtgctgcggggaaaccccgcggtggatggatggctacccgttccggcgcgcaagcggatctgcgctaacgcgcagcccagctggcgcatcaccggcaggttgaagg

SEQ ID NO: 17963 - RNA, 135 nt, unidentified
  source 1..135: mol_type = other RNA; note = Related to NZ_CP046508.1; note = Variovorax sp.
gacaaggcgggcgattcgtcgctttccttgtgctgcggggcacccccgcggtcgatggatgggtacgcatttcggcgcgtgagcggaactgcgctgtcgcgcagcgcagctggcgcatcaccggctggttgaagg

SEQ ID NO: 17964 - RNA, 147 nt, unidentified
  source 1..147: mol_type = other RNA; note = Related to NZ_RXFT01000006.1; note = Variovorax guangxiensis
ttcaagactcgacaaggccctgcgatccgtcgcccggtcttgtgctgcggggtaaccccgtggcggatggatggcttcgcattccggcgcgcaagcggcgctgcgcatccgcgcagaccagctggcgcatcaccggctggttgaagg

SEQ ID NO: 17965 - RNA, 147 nt, unidentified
  source 1..147: mol_type = other RNA; note = Related to FOLP01000001.1; note = Variovorax sp.
ttcaagactcggcaaggcttcgcgatccgtcgttcggccttgtgctgcggggataccccgtggtggatggatggctacccatttcggcgcgcaagcgcgtctgcgctcacgcgcagcacagctggcgcatcaccggctggttgaagg

SEQ ID NO: 17966 - RNA, 147 nt, unidentified
  source 1..147: mol_type = other RNA; note = Related to FOWG01000009.1; note = Variovorax sp.
ttcaagacacgacgaggccctgcgatccgtcgccttgcctcgtgctgcggggtacccccgcggtggatggatggttgcccattccggcgcgcaagcgggactgcgctcacgcgcaggacagctggcgcttcaccggctggttgaagc

SEQ ID NO: 17967 - RNA, 147 nt, unidentified
  source 1..147: mol_type = other RNA; note = Related to FPBM01000001.1; note = Polaromonas sp.
tccaagtgttgcgagcggaatgcgattcgttgctgcccgtccgcaccatggggtacccccatggttgttttgtactctgcgatttcggcgcgtgagcggcctgcgcattctgcgcacccagctcacgcgggacctgctggttgggat

SEQ ID NO: 17968 - RNA, 147 nt, unidentified
  source 1..147: mol_type = other RNA; note = Related to FNJA01000002.1; note = Rhodoferax sp.
gccaagtgtcgtgagcccagggcaatacgttgttctgactcgcactgtggggtacccccacggttgttttattaccgagccatctcggtgcgtgcgccacacgcgcatgctgcgcggactgcccacgccggacctgctggttgacgc

SEQ ID NO: 17969 - RNA, 151 nt, unidentified
  source 1..151: mol_type = other RNA; note = Burkholderiales bacterium; note = Related to JACRAZ010000105.1
gccaagcgttcaccggttgccggccgatccgtcgaccgacaccgggctccggggtttccccggggcaggttcatcacccagtcctttcggcgcgtgaccggccgtgcgctgaccgcgcacacaaggtcacgcctcacccgcaggttggcgg

SEQ ID NO: 17970 - RNA, 142 nt, unidentified
  source 1..142: mol_type = other RNA; note = Related to SCTQ01000267.1; note = Aquabacterium sp.
gcgaggcccttgcggaaggcgattcgtcgcttgccgtgccgcggggcacccccgcggttcactgatcactcaggcacttcgtcgcgcgaccttcagtgctcgatcgagcacggctgctcgcgcctgaccggctcgctcgcag

SEQ ID NO: 17971 - RNA, 142 nt, unidentified
  source 1..142: mol_type = other RNA; note = Related to NZ_LMDI01000005.1; note = Rhizobacter sp.
cccaagcacatcgtggaccggcgcttcggaaccgggtctgccccgcggggtacccccgcggtggattgttggctggtacatcctgggcgtgaggcgacggcgcaatgcgcccacacctcacgcatcacccgcaggttgggcg

SEQ ID NO: 17972 - RNA, 145 nt, unidentified
  source 1..145: mol_type = other RNA; note = Related to PTEU01000001.1; note = Ideonella sp.
cgcaagtgtttcgcgagaccgttcttttcaagagcactcgcacagcggggttcccccgtctgttgaattgtgttgtggccaccgaggcgtgatcgacctggcgacccgtcgccaaccagatcacgcatcacctgcaggttgtgta

SEQ ID NO: 17973 - RNA, 142 nt, unidentified
  source 1..142: mol_type = other RNA; note = Candidatus Aquabacterium excrementipullorum; note = Related to DXIO01000116.1
tccaagtttccggcgatccagttcatgcaattggctcgcactctggggataccccagggttacccatcggcatcccgacgagaggcatgtgcgggtcggcgatcctcgccgctcagctcacgcatcacccgcaggttggatg

SEQ ID NO: 17974 - RNA, 127 nt, unidentified
  source 1..127: mol_type = other RNA; note = Related to NZ_JAJNKD010000019.1; note = Ideonella azotifigens
ctcgtgctggcggtggcgtcttcgcgccgcggggtacccccgcggttgatggtttgcctggtactttcggggcgtgagcggagtggctgtttgccaatcagctcacgcatcacccgcaggttgggtg

SEQ ID NO: 17975 - RNA, 146 nt, unidentified
  source 1..146: mol_type = other RNA; note = Burkholderiales bacterium; note = Related to JAEKKG010000289.1
cccaagtgtccttcggaacgttcatcgaacccattccgatccgcggggtacccccgtcggcaacgctcttgtcatgcccatccgaggcgatggccaccgcgtcgctgcgcgacgccacaccattcgcatcaccagcaggttgggcg

SEQ ID NO: 17976 - RNA, 132 nt, unidentified
  source 1..132: mol_type = other RNA; note = Related to JAJTWU010000010.1; note = Pelomonas sp.
ccgaggtcctggcaagccttcacgggtttgcactccggggtacccccgggggttgccgatctcgcgtccagcagggcatggagcgcggggcgctgtgcgcccgacaccccatgcatcacccgtcgctcgggc

SEQ ID NO: 17977 - RNA, 134 nt, unidentified
  source 1..134: mol_type = other RNA; note = Related to NZ_LMFP01000011.1; note = Pelomonas sp.
cccgaggtctttgccagccttcacgggcgggcactccggggcacccccgggggtcttgaatctctcgtccggcagggcgcgagcccggtggcgcaaagcgccaggcagctcacgcatcacccgtcgctcgggca

SEQ ID NO: 17978 - RNA, 131 nt, unidentified
  source 1..131: mol_type = other RNA; note = Related to JAJTWT010000006.1; note = Pelomonas sp.
ccgaggtcttcgcgagcctttgggcaagtactccggggcacccccgggggtcatggatgtctcgacccgcagggcgtgagaacgccgggcgcacagcgcccttcacctcacgcatcacccgtcgctcgggc

SEQ ID NO: 17979 - RNA, 133 nt, unidentified
  source 1..133: mol_type = other RNA; note = Related to JAACZV010000015.1; note = Comamonadaceae bacterium
ccgaggtctttgccagccctcacgggccagcactccggggcaaccccgggggtcttgaatctcgcgtccagcagggcgtgagcggtcccggcgcaaggcgccagccacctcacgcgccacccgtcgctcggtc

SEQ ID NO: 17980 - RNA, 134 nt, unidentified
  source 1..134: mol_type = other RNA; note = Related to JAEKLF010000057.1; note = Burkholderiales bacterium
ccgaggtctttgccagccttcacgggcgggcactccggggcaacccccgggggttctgagtctctcgtccagcagggcgtgagaacgcctggcgcaatgcgccaatcacctcacgcaccacccgtcgctcgggc

SEQ ID NO: 17981 - RNA, 150 nt, unidentified
  source 1..150: mol_type = other RNA; note = Related to QAJN01000008.1; note = Paucibacter sp.
cccaagttctccgtgaagtgcatgcacggctgtgtttgcgcctcacacccaggggcaccccctgggtcatgtttttgttgaagtcaatcggggcctgatcggcgtggcgctgtgcgccagtcggatcaggcaggacccgcaggttgggca

SEQ ID NO: 17982 - RNA, 138 nt, unidentified
  source 1..138: mol_type = other RNA; note = Related to LMHL01000001.1; note = Rhizobacter sp.
gccgagcagaaacgggttgcagtacggacccggctgtggggcacccccacggcatcgagtcgactttggcattcgcggtgcaagcccgacgtgcgctgacgcgcacgccagctgaccacgagaccggcaggtcggcgt

SEQ ID NO: 17983 - RNA, 138 nt, unidentified
  source 1..138: mol_type = other RNA; note = Related to FRCQ01000002.1; note = Rhizobacter sp.
gccgagcagacacgggtcgccgttcagggcccggctgtggggtacccccatggcatcgaatcgatcttggcatccgcggtgcaagagggtgtgcgctgacgcgcacgtcttcttggcacgggaccggcaggtcggcgt

SEQ ID NO: 17984 - RNA, 139 nt, unidentified
  source 1..139: mol_type = other RNA; note = Betaproteobacteria bacterium; note = Related to VBCX01000083.1
tccaagcacgacgcaagttcagttgttcggacttgcgctgtggggcacccccatggctttgattcgacgatggcatacgcggcgtgagccgcaatgcgcggtgcgcgtgattgctcacgcgagaccggcaggttggagt

SEQ ID NO: 17985 - RNA, 141 nt, unidentified
  source 1..141: mol_type = other RNA; note = Sandaracinaceae bacterium; note = Related to JACKEI010000001.1
accgagcgtgcacactctggcggagctcgtctctgcctctccggggttaccccggagacacgacctagtcgcccattgcgaggcgcgcccgtccggacacttcatgtccgcctgggcgggcccggcgggactcgtcgggga

SEQ ID NO: 17986 - RNA, 131 nt, unidentified
  source 1..131: mol_type = other RNA; note = Sandaracinaceae bacterium; note = Related to JACKEJ010000006.1
cgcaacgcggcagagcctggctctgcctctccggggttaccccggggacacgtatcgaccacccttcacgaggcacgtccgccccgacaccccatgtcgatctggacgcgccccttcggactcgtcgggga

SEQ ID NO: 17987 - RNA, 139 nt, unidentified
  source 1..139: mol_type = other RNA; note = Deltaproteobacteria bacterium; note = Related to JACRCU010000218.1
gccaagcagaccaccggcagccctgccgcggtctctctggggctaccccagggcaaattcatcggcctgcccggccaccgcaggacccgcagcgtcgctccgcacgcgtccggtcctgcacgacgagcgaggttggcgc

SEQ ID NO: 17988 - RNA, 137 nt, unidentified
  source 1..137: mol_type = other RNA; note = Related to JACKIB010000005.1; note = Planctomycetes bacterium
tgcgagactggtgtgcgcccatggcgcacaccgctccggggcttccccggggactcaaatctgactgacgcatctcgagcacgacagctcagcggcggacgccgctcccgagtcgcgccccacacgtaggtcgcggt

SEQ ID NO: 17989 - RNA, 135 nt, unidentified
  source 1..135: mol_type = other RNA; note = Chromatiales bacterium (ex Bugula neritina AB1); note = Related to MDLA01000158.1
tcctggttcttccagcgtagttaactcctcgctgggctttggggctaccccaaggtaatgtattgcttccattacgtggccagaacggccctgcactgcgtgcagatctgttcttgcgatattatgagcaggatg

SEQ ID NO: 17990 - RNA, 133 nt, unidentified
  source 1..133: mol_type = other RNA; note = Related to JAHQWB010000596.1; note = Granulosicoccus sp.
tccaagctattcccgtaagctctgtgcttatcggactctggggataccccagggttgaatactacaggcatttcacggcaggaacgatattgcacttcgtgcaagcccgttcatgcgattcaagggttggatg

SEQ ID NO: 17991 - RNA, 133 nt, unidentified
  source 1..133: mol_type = other RNA; note = Gammaproteobacteria bacterium 45_16_T64; note = Related to MABD01000012.1
tccaagctataccgactaagctaaggtttgggcgggctttggggttaccccaaggttgagttttactggcgttacgttgcgaaaacggtgttgcacggtgtgcaagtccgtttacgcgaattagggttgggtg

SEQ ID NO: 17992 - RNA, 134 nt, unidentified
  source 1..134: mol_type = other RNA; note = Related to NZ_ML660090.1; note = Exilibacterium tricleocarpae
ctcaagcattacctggtggcttgtccttcagggctttggggtaaccccaaggcggtggtttgtcggcttaacgttgcaagtatggtattgcaccttcagtgcaaagctatacttgcgtggggcagggttgagtg

SEQ ID NO: 17993 - RNA, 152 nt, unidentified
  source 1..152: mol_type = other RNA; note = Related to NZ_CP035490.1; note = Hahella sp.
ttcaagcgagcgtgatccggaaccggcgcgaccgggcctgatccgttgctccggggctaccccggggttacatgttgactacgcatatcgccgtccataccgccctacgccaaggcgtagaacggtatcgaccacgggaggagggttggagc

SEQ ID NO: 17994 - RNA, 152 nt, unidentified
  source 1..152: mol_type = other RNA; note = Related to NC_007645.1; note = Hahella chejuensis
ttcaagcgaacgtgatccggaaccggcgcgaccgggccaggtccgttgctccggggctaccccggggttacatgttgactacgcatatcgccgtccataccgccctacgccaaggcgtagaacggtatcgaccacgggaggagggttggagc

SEQ ID NO: 17995 - RNA, 151 nt, unidentified
  source 1..151: mol_type = other RNA; note = Related to NZ_AQXX01000078.1; note = Hahella ganghwensis
ttcaagcgattccggaagcaatgagtcagtcatttgtcaccggaaactccggggttaccccggggttaaacgtcaacgacacatatcaccgccggtaaggccctgcgctatgcgcgcagatactttaccggcaacacgagttggttgaagt

SEQ ID NO: 17996 - RNA, 150 nt, unidentified
  source 1..150: mol_type = other RNA; note = Related to MRYI01000026.1; note = Hahella sp.
tccaagcgaacctgacaggctaaggtacgacctctgccagtcggtacttcggggtaaccccgaggctatgcgttaaccattcatttcaacgccggtaaggcactgcgctataagcgcagccggttaccggctacttcagcgggttggagt

SEQ ID NO: 17997 - RNA, 127 nt, unidentified
  source 1..127: mol_type = other RNA; note = Related to JABLXQ010000049.1; note = Gammaproteobacteria bacterium
cctgagcctgtgttgtccccgtacaacacgctttggggttaccccaaggtccatcctgatccaccgttgcatcgtatgaacttcgctgcgctgcgcgcagtgcagttcacacgagagtagtcgtctc

SEQ ID NO: 17998 - RNA, 140 nt, unidentified
  source 1..140: mol_type = other RNA; note = Alteromonadaceae bacterium 2753L.S.0a.02; note = Related to VISH01000001.1
atcaggacatagcccataaaacttgttttacagggcgctttgaggttacctcaaggttatcgtatgcagttagacctatcagggtgtgtacggcggtgcgcggtgcgcacggaagtacacacagaaccagcggctggtgt

SEQ ID NO: 17999 - RNA, 159 nt, unidentified
  source 1..159: mol_type = other RNA; note = Related to RCHN01000046.1; note = Ketobacter sp.
atcaggacttgggaacagagcctcaacctggacacgttcagatcgagctttgctccgctccggggctaccccggggtttttcaggatcaccccatgacattgccaggatgtccggtgcgctccacgcacgggactcctgacggtaccggcggctgatac

SEQ ID NO: 18000 - RNA, 135 nt, unidentified
  source 1..135: mol_type = other RNA; note = Methylococcales bacterium; note = Related to JABJPU010000111.1
ttcaaggttttgggatgcatcgtcaacccaactttggggttaccccaagggtgtagtaaattgaaacaatccatgccgtgagcaacgtggcattgtcatgccaatatgctcacgtatgacaagttaagttgaagg

SEQ ID NO: 18001 - RNA, 148 nt, unidentified
  source 1..148: mol_type = other RNA; note = Alphaproteobacteria bacterium; note = Related to CP065008.1
tgcgagatgttcccaatcaatagcctgactatgacgggaactctgcggggcatccccgcggattggatcaaaactggacatttcacgcctgtacgccaagtgcgctgacacgcactgcgcgtacaagcacgacgagacgggtcgcagg

SEQ ID NO: 18002 - RNA, 147 nt, unidentified
  source 1..147: mol_type = other RNA; note = Related to JAGRIJ010000030.1; note = Alphaproteobacteria bacterium
cgcgagaatgttcctgagcgttagcatgactatatcagggactctgcggggcatccccgcggattgtttttaacgcaaccatatcgtcaccattacttcgttgcgctccgcgcaaacatgtaatggcaaaaccggacaggtcgcccg

SEQ ID NO: 18003 - RNA, 144 nt, unidentified
  source 1..144: mol_type = other RNA; note = Related to QFQP01000062.1; note = Archangium gephyra
gtcaggccactcgatgaagtcacttcggtgacgacgtcagctccggggttgccccggggtgtggtcgtacgcaacacaggcaggagcaggtgcgcggtccactctcgtggacggggcaccatgcagcacaggcgtcgctgacgc

SEQ ID NO: 18004 - RNA, 145 nt, unidentified
  source 1..145: mol_type = other RNA; note = Related to JAACJQ010000409.1; note = Archangiaceae bacterium
agcaggatttcgatgtgcctcgcagtcctggagtcacgtctcttcggggcatccccgagggtgtggagcaattcaccgtgtcgtcgcgacgtcttgcgcggcactgcgtgccggagcgacatcgcagagctggtcaggctgttct

SEQ ID NO: 18005 - RNA, 176 nt, unidentified
  source 1..176: mol_type = other RNA; note = Related to JAEUIQ010000011.1; note = Planctomycetaceae bacterium
tccaagctgattgaatcgttggtagttttacctctgggtgtttgcgaaagcgaattcccatgcgatttgatctcggcggggttaccccgtcgttgactcgataggctggcatttcaggctgtggtagagtgcgccctcgcgcacgattccacagcgcaaactggtttggttgggcg

SEQ ID NO: 18006 - RNA, 137 nt, unidentified
  source 1..137: mol_type = other RNA; note = Related to JADKJO010000032.1; note = Propionivibrio sp.
tccaggcgggttcgggttgcaagcagcccaaccgctccagggttaccctggggacttcttgatggctaatacttcgttgcctgagcgccgcacgcctgcggcgtgttcagctcaggctccacacgacaggctggaga

SEQ ID NO: 18007 - RNA, 139 nt, unidentified
  source 1..139: mol_type = other RNA; note = Related to NZ_AUCH01000007.1; note = Azovibrio restrictus
tccaggcgtaagccgtcctcctcggagtccggcggctctggggttaccccagggatgttctggtagtccggtatttccctgcctgagcggcccacgcctgcggcgtgatctgctcaggcaccacacgacaggctggagg

SEQ ID NO: 18008 - RNA, 140 nt, unidentified
  source 1..140: mol_type = other RNA; note = Related to NZ_CP075192.1; note = Ferribacterium limneticum
tccaggtgggtatcgggttgcattcaggcccggccactccggggttaccccggggatttttcggtagtttgcttattcattgcttgagcctcccacgcctgcggcgtgagcagctcaagcgccacacgacaggctggaga

SEQ ID NO: 18009 - RNA, 140 nt, unidentified
  source 1..140: mol_type = other RNA; note = Proteobacteria bacterium; note = Related to JAGTRU010000007.1
tccaggtgggttacgggttgtcgtcaaacccggccactccggggttaccccggggatttttcggtagttcggtttttccttgcctgagcgtcacacgcctgcggcgtgagcggctcaggcaccacacgacaggctggaga

SEQ ID NO: 18010 - RNA, 137 nt, unidentified
  source 1..137: mol_type = other RNA; note = Related to WBUO01000290.1; note = Dechloromonas sp.
tccaggcgggttcggattgtctgcaatccggccacgccggggctaccccggcggtttttcgcagttggacttttcatcgcctgaacctcacacgccgctggcgtgacctgttcaggcaggacacgacaggctggaaa

SEQ ID NO: 18011 - RNA, 130 nt, unidentified
  source 1..130: mol_type = other RNA; note = Related to JAGRFZ010000003.1; note = Rhodocyclaceae bacterium
gccaggcgggccggctcggatcggccgctccggggctaccccggggactcactcgaccttcccattgacgcgcctgaacgcttcacgccgctggcgtgcccggttcaggctccacacgacaggctggcga

SEQ ID NO: 18012 - RNA, 130 nt, unidentified
  source 1..130: mol_type = other RNA; note = Rhodocyclaceae bacterium; note = Related to JAGRFY010000153.1
gccaggcgggccgacgccgatcggccgctccggggttaccccggggactccctcgaccttcccattgacgcgcctgaacgcctcacgccaccggcgtgcccggttcaggctccacacgacaggctggcga

SEQ ID NO: 18013 - RNA, 144 nt, unidentified
  source 1..144: mol_type = other RNA; note = Related to NZ_KB892867.1; note = Uliginosibacterium gangwonense
cccaagcacaggctgatgcctgccttgcagacattggctcctccggggttaccccggggcgatacttgagctggcatttccgtgcatgagcccctctgcgcctgcggcgcagccaagcgcatgccacacacgacaggttgggcg

SEQ ID NO: 18014 - RNA, 141 nt, unidentified
  source 1..141: mol_type = other RNA; note = Rhodocyclaceae bacterium; note = Related to JAEUNN010000841.1
ttccagcgcgagtcggaggcacaagtgccttccggccacttcggggctaccccggggatgagtgatgttccggcattgcgtggcatgagccccgcggcgctccgcgccgggcagctcatgcaggacacggcaggtggaagg

SEQ ID NO: 18015 - RNA, 127 nt, unidentified
  source 1..127: mol_type = other RNA; note = Related to JAHCAA010000009.1; note = Rhodocyclaceae bacterium
ggccaggcttggccggtccggccactccggggctaccccggggatgattgtatttccggcatttcgtggcatgagcgtgacagcgcgctgcgccgggccgctcatgcaggacacggcaggtggaagc

SEQ ID NO: 18016 - RNA, 142 nt, unidentified
  source 1..142: mol_type = other RNA; note = Sterolibacteriaceae bacterium; note = Related to JADJSA010000006.1
tccaagcgcagcggcagggagtcgagaaactcctccgcgctcttgggttacccaagggtccagcatttccggcaaggcgcggcatgagcgccgctgcgcctgcgacgcaggactgctcatgcacgacacgacaggttggagc

SEQ ID NO: 18017 - RNA, 143 nt, unidentified
  source 1..143: mol_type = other RNA; note = Related to JADJHQ010000003.1; note = Sterolibacteriaceae bacterium
tccaagcacaacggtcagaggttcgagcaacccctccgcgctcttgggctacccaagggtcgagcacttccagcatcacgcggcatgagcggcactgcgcctgcggcgcagggttgctcacgcacgacacgacgggttggatt

SEQ ID NO: 18018 - RNA, 144 nt, unidentified
  source 1..144: mol_type = other RNA; note = Related to NSJF01000001.1; note = Vandammella animalimorsus
tgcaggtcttcactggcatcgcccatggcgaccgcatgaccatggggcacccccatggatgcagacacacttggaaatcgcagcggctgtgccccacataccccagggtatgcaccgcacagccaggacacgacgggctgaagc

SEQ ID NO: 18019 - RNA, 137 nt, unidentified
  source 1..137: mol_type = other RNA; note = Related to JAKGTI010000001.1; note = Maritalea sp.
ctctggttatgcctatacgacagtgtaaggcatggagcggggcatccccgtttataagtgttactgagacaaacacggcgctaccggcactgggcttcacccagatttggtagcgcaggacaaagaaaagcagaggc

SEQ ID NO: 18020 - RNA, 136 nt, unidentified
  source 1..136: mol_type = other RNA; note = Related to FNUZ01000001.1; note = Thalassococcus halodurans
ttttggatacccttcgcatctacgcaaagggacgggcggggcatccccgtctattagactgaccttagcaaacacggcacaaccgcatctgggcgttgcccagtatgggtggtgcaaaaccgagacaggcaaaaac

SEQ ID NO: 18021 - RNA, 137 nt, unidentified
  source 1..137: mol_type = other RNA; note = Related to JAESRD010000022.1; note = Rhodobacteraceae bacterium
ctttggaatgctctgtacagcaatgtagagagcggggcggggtatccccgtctgagacgatgagctacgcaaacacggcaataacgacgctgggcgctgcccagaatagttgttgcaaggcgaaggtgagcaaagat

SEQ ID NO: 18022 - RNA, 137 nt, unidentified
  source 1..137: mol_type = other RNA; note = Related to VICH01000004.1; note = Aliiroseovarius halocynthiae
tcaaggaccgcttgttttctcaatgaatcaagcaggttggggcatccccaactttacctatgacctctgcatacacggcatcaccgacactgggcttcgcccagcacaggtgacgcaagaccgagattggcttgagt

SEQ ID NO: 18023 - RNA, 137 nt, unidentified
  source 1..137: mol_type = other RNA; note = Hyphomicrobiales bacterium; note = Related to JABDJG010000107.1
ctttggatggctctttgcagcaatgtaaagagtggggcggggtatccccgcctgcgacgaccaccaagccaaacacggcgctaccgacgctgggctacgcccagtaccggtaacgcgagaccgaggaaagctgagac

SEQ ID NO: 18024 - RNA, 137 nt, unidentified
  source 1..137: mol_type = other RNA; note = Related to JAGRLY010000042.1; note = Alphaproteobacteria bacterium
ctttggataacgctgtgcagaaatgtgcagggttgggcggggcatccccgcctgcgacgacgacctgagcatacaaggcgttaccgccgctgggcttcacccaggtggggtaacgcgaaacgaagatgagcaaagac

SEQ ID NO: 18025 - RNA, 140 nt, unidentified
  source 1..140: mol_type = other RNA; note = Related to NZ_JAEHHL010000001.1; note = Proposed Thermohalobaculum xanthum
catgggttggccggggtcgcgagacccgagggcccgggcggggcatccccgcccgacgaccaagacctggcaagacgtggcatgcccgtccgtgggcgcaggcccacgcaggggcatgcgggaccgagtgaggccatgac

SEQ ID NO: 18026 - RNA, 135 nt, unidentified
  source 1..135: mol_type = other RNA; note = Related to NZ_FOIZ01000001.1; note = Cognatiyoonia koreensis
ctctggaatgatgcgcctgcatggcacatcggggcggggtatccccgtctgagagaacgacctgcacatcacatggcctgaacgtctctgggtttcacccagtgccgttccagcatgacaagaaggagcagagac

SEQ ID NO: 18027 - RNA, 134 nt, unidentified
  source 1..134: mol_type = other RNA; note = Related to NZ_BLJE01000002.1; note = Litoreibacter roseus
ctttggattggtgcaccttttggtgagcctggggcggggtatccccgtctgatgacattgctccgacacactgtggatatccgccactgagtttcactcaggacgggatatccaaagcacagaatagcagaggt

SEQ ID NO: 18028 - RNA, 128 nt, unidentified
  source 1..128: mol_type = other RNA; note = Related to JACXGQ010000004.1; note = Yoonia sp.
ctctggctggtgtctttgataccaagggcggggtatccccgcctgaccaaacgacctttgcatacacggcatcaccgtgactgggcgttacccagtcctggtgacgcgcgaccaagaaaggcagagat

SEQ ID NO: 18029 - RNA, 127 nt, unidentified
  source 1..127: mol_type = other RNA; note = Related to NZ_PKFN01000009.1; note = Yoonia maritima
ctctggttggcgcttcacggcaccggggcggggcatccccgcctaacttaccacctttgcatacacggcatcaccgttactgggcgcagcccagcgcgggtgatgcgcgaccaagaaaggcagagat

SEQ ID NO: 18030 - RNA, 130 nt, unidentified
  source 1..130: mol_type = other RNA; note = Related to NZ_JADCKQ010000007.1; note = Paenihalocynthiibacter styelae
ttccggaacgtgcccgttaagggtgcagggcggggtatccccgtctgattttaatacgatgcaattcggggcgcgccggcgcgtgggctttcacccacctcccggcacgcagaaccaggttggcggaaat

SEQ ID NO: 18031 - RNA, 129 nt, unidentified
  source 1..129: mol_type = other RNA; note = Related to FWXB01000002.1; note = Roseovarius aestuarii
tccaagccgccggagaaattcggccggatggggcttccccatcttactaccgttacgctggacattcggcgcatgaccgccactgggcttcgcccaggaccggtcatgcaggacacgacaggttggggt

SEQ ID NO: 18032 - RNA, 130 nt, unidentified
  source 1..130: mol_type = other RNA; note = Related to DQCI01000287.1; note = Rhodobacteraceae bacterium
cccaagacgccggagcaattcggccgggcggggtttccccgccctcgcatccgtcagactggacattcggcgcatgaccgccgctgggcttcacccaggaccggtcatgcaggacacgacaagttggggc

SEQ ID NO: 18033 - RNA, 127 nt, unidentified
  source 1..127: mol_type = other RNA; note = Related to NZ_NSBT01000024.1; note = Actibacterium ureilyticum
ctcaagcggccgcgcaaccggccgggcggggcttccccgcccaaatctcgttacactggacattcggcgcatgaccgggactgggctgcacccagtgcgggtcatgcaggacacgacaggttgaggc

SEQ ID NO: 18034 - RNA, 128 nt, unidentified
  source 1..128: mol_type = other RNA; note = Related to NZ_BMYJ01000004.1; note = Gemmobacter tilapiae
ttcaaggggtggagcgatccacagggccggggcttccccggccagacgatcccagttggaacattcgacgcgtggaactccctgggccttacccagagctttccacgcaggacaggaaaggttgaacc

SEQ ID NO: 18035 - RNA, 128 nt, unidentified
  source 1..128: mol_type = other RNA; note = Related to NKIU01000001.1; note = Pseudorhodobacter sp.
gtcaagacgccgggcatcccggctgggcggggcttccccgcccatctttcgcacgttgtgacattcgacgcatggccttgcctgaacatcattcagatccggccatgcaggacaggtgaggttgaccc

SEQ ID NO: 18036 - RNA, 127 nt, unidentified
  source 1..127: mol_type = other RNA; note = Related to JADJTJ010000002.1; note = Rhodobacter sp.
gccaagatgccggatctccggccgggcggggcttccccgtcccattcgacgcaagttgcacattcgacgcatgaccgggcctgggcttcacccagatcaggtcatgcaggactggtgaggttggccc

SEQ ID NO: 18037 - RNA, 126 nt, unidentified
  source 1..126: mol_type = other RNA; note = Related to NZ_WCHR01000012.1; note = Gemmobacter serpentinus
gccaagcgccgggcaaccggaggggtggggcttccccacccgaaaaacgcaacgccagacattcgacgcaaggacggcgccgggctctgcccgggtcagtccttgcaggaccagagaggttggacc

SEQ ID NO: 18038 - RNA, 126 nt, unidentified
  source 1..126: mol_type = other RNA; note = Related to NZ_VKKX01000051.1; note = Gemmobacter caeruleus
accaagcgccgggcaaccggaggggcggggcttccccgcccgcatcgcatcacgcctgacattcgacgcatggccgtcgccgggcgccacccgggccgggccatgcaggaccagagaggttggcgc

SEQ ID NO: 18039 - RNA, 126 nt, unidentified
  source 1..126: mol_type = other RNA; note = Related to CP059262.1; note = Exiguobacterium profundum
gtcaagatgccgggaaaccggtcgggcgggcttcccgacccgcagcacgcaaggccgccgattcgacgcaggaccgtccccgggcttcacccggaccgggtcctgcaggaccagagaggttgaccc

SEQ ID NO: 18040 - RNA, 131 nt, unidentified
  source 1..131: mol_type = other RNA; note = Related to NZ_WQIE01000002.1; note = Ruegeria sp.
ctcaagaccgtgggcaaccacattctgcggggtttccccgtggcttacgacctgactgcatacattcggcgcatgacccaggcttgccgttggcaaggacaggtcatgccgaacagagatatggttgaggg

SEQ ID NO: 18041 - RNA, 133 nt, unidentified
  source 1..133: mol_type = other RNA; note = Related to NZ_RYZK01000009.1; note = Shimia sediminis
ttcaagacttttgggttctacccaaatttggcggggcatccccgtcgcaaacaacgttaccttggccattcggcgcaaaaccctgactgggcttcacccagcgcaggttgtgccagacatgtgaggttgaaag

SEQ ID NO: 18042 - RNA, 134 nt, unidentified
  source 1..134: mol_type = other RNA; note = Related to NZ_JABUFE010000011.1; note = Sulfitobacter algicola
cttaagatatcggggccttgtcccgaccgggtggggcttccccatccgaaccaaccttacttgcagcattcggcgcaaaggcttgattgggcgctgcccaaggcagcctttgccagtccagatcaggttaagcg

SEQ ID NO: 18043 - RNA, 143 nt, unidentified
  source 1..143: mol_type = other RNA; note = Related to NZ_JAKJIC010000019.1; note = Pleomorphomonas sp.
gtcaagatactcccgtcatcgcgtgcgatgggggagagctgcggggttaccccgcggcagccttgttacctggacacttccgccgcatgaacagcactgggctctgcccaggaccgctcatgcaggacatgtagggttgatcg

SEQ ID NO: 18044 - RNA, 139 nt, unidentified
  source 1..139: mol_type = other RNA; note = Parvularculaceae bacterium; note = Related to JAIENJ010000270.1
ttcaagcattctcgcaacgcgcgcgttgtcgagatcttcggggcaaccccgggggcaagttattatctgcacagcacgctgcgtgacccgccgaaggctttgcctacccaaggtcacgccaaaccagacgagttgaagc

SEQ ID NO: 18045 - RNA, 140 nt, unidentified
  source 1..140: mol_type = other RNA; note = Related to JAEUMS010000015.1; note = Hyphomonadaceae bacterium
ttcaagcaatcccggaaacgttcgcgttgacgggatcttcggggataccccgaggacttcttgttttccgcacagagcgctgcgtgacgcgcggcaggctttgcctgcgttacgtcacgccaaaccagttgagttgaagt

SEQ ID NO: 18046 - RNA, 131 nt, unidentified
  source 1..131: mol_type = other RNA; note = Related to JAEUMQ010000004.1; note = Hyphomonadaceae bacterium
ttcaagcttcccggcgaaagcttgggatctctggggctaccccaggggctcatcgaactcggaccatacgttgcgtgatccccggtaggctgtgcctacgttcgatcacgccagacaagacgcgttggagc

SEQ ID NO: 18047 - RNA, 137 nt, unidentified
  source 1..137: mol_type = other RNA; note = Related to NZ_LMUJ01000042.1; note = Acidisphaera sp.
tccaagcaatccctgacaccgaatcagggatcttcggggcaaccccggggttagtcgcgtttccaaggcagaacgttgcatggacgtgggtaggcttccgcctacggtcggccatgccggacgggttgggttggaag

SEQ ID NO: 18048 - RNA, 135 nt, unidentified
  source 1..135: mol_type = other RNA; note = Hyphomonadaceae bacterium; note = Related to JADLHI010000158.1
ctcaagcactccggtgcggctagcatcggacctccggggttaccccggggaggcattcacacctgagcatcacgcagcacggtacgcggtgggctctacccacgatataccgcgcataacaagaggggttggggc

SEQ ID NO: 18049 - RNA, 146 nt, unidentified
  source 1..146: mol_type = other RNA; note = Related to JADFVY010000399.1; note = Proteobacteria bacterium
ttcaagcaagtcctggcgatgcatcgcaagacggccgggactctccggggttaccccgggggacgaacgttactctgccattgccgtgcatgacccccttcaggcttcgcctgagacaggtcatgcgtgacgagacgggttgaagg

SEQ ID NO: 18050 - RNA, 147 nt, unidentified
  source 1..147: mol_type = other RNA; note = Related to JAEUME010000009.1; note = Hyphomicrobium sp.
ttcaagacaggcccggtcggtcacttcggtgccgtcgggtctctttggggttaccccaaggatatttcactattgtgctcagcccgcaacgcgatgccgggtaggtccgccctacgttacatcgcgtccgacacgttgggttgaagt

SEQ ID NO: 18051 - RNA, 147 nt, unidentified
  source 1..147: mol_type = other RNA; note = Chitinophagales bacterium; note = Related to JACMJQ010000424.1
ctcaagcaatcttcatgatgcgtttctgacgctattggagatctctggtgataccccaggggagactttttactcaggcaactcacggcatgatgcgcggtaggcctttgcctacatgtcatcaagcttcatacgacgggttgaggc

SEQ ID NO: 18052 - RNA, 145 nt, unidentified
  source 1..145: mol_type = other RNA; note = Related to JABFRX010000116.1; note = Alphaproteobacteria bacterium
ttcaagacttctccatgcggcttcggccggagggagatctctggggttaccccaggggacagaatggacgccagtaagacgcggcataggccgcgctgggcacgtcgcccagaatagcctacgcatcacgacgacaggttgaagc

SEQ ID NO: 18053 - RNA, 145 nt, unidentified
  source 1..145: mol_type = other RNA; note = Alphaproteobacteria bacterium; note = Related to JAIOQG010000119.1
ttcaagactccctgacgctgcacttcggttcagccagggaactccggggttaccccggggaacattcacaacgccagaaagacgtcgcataaccctcgctgggctgcacccagggccggttatgcctcacatgatgggttgaagt

SEQ ID NO: 18054 - RNA, 144 nt, unidentified
  source 1..144: mol_type = other RNA; note = Related to JAEUML010000192.1; note = Alphaproteobacteria bacterium
ttcaagacttctccgattgagcctcggttcggacggagatctctggggctaccccaggggaaatctcatacgcagtgaagacacggcgaaacgcacggtgggctacacccacataccgttttgcatgacgcgacgggttgaagc

SEQ ID NO: 18055 - RNA, 138 nt, unidentified
  source 1..138: mol_type = other RNA; note = Related to JADMJM010000043.1; note = Hyphomonadaceae bacterium
ttcaagaatgtcggtgcatttcgatgcgcggacgcttcggggttaccccgaaggagaactgtagccaacacaatacgttgcacgatgcgcggcaggcttcgcctgcaacccatcgagcctctctcgtttggttgaagc

SEQ ID NO: 18056 - RNA, 135 nt, unidentified
  source 1..135: mol_type = other RNA; note = Proteobacteria bacterium; note = Related to JAFECD010000003.1
gccaagcagtcctgggcaaccgggactctctggggctaccccaggggcattgatgacctcacgcagaacgcagcgaagagttccggtccgctccgccggacctgggctcctcgccagacacggtcgggttggcgc

SEQ ID NO: 18057 - RNA, 133 nt, unidentified
  source 1..133: mol_type = other RNA; note = Related to JABFRT010000004.1; note = Hyphomicrobium sp.
gctaagaactcctgggaaaccgggactctctggggttaccccaggggacaatatcaccacacgcacgacgcagcgtgggcctcgggtaggcagaacctaccggctgcccacgcaagacacggtaggttggcgc

SEQ ID NO: 18058 - RNA, 147 nt, unidentified
  source 1..147: mol_type = other RNA; note = Related to JAEUMD010000019.1; note = Hyphomicrobiaceae bacterium
ctcaagccgagaacgatgcttcatgccttggagcgtcgtgcctccggggctaccccgggggcgtgaattctaccccagcattcggcggcgtgatgcccggacgcctcgcggcgtcgaagcatcacgcaagacgtgattggttggggc

SEQ ID NO: 18059 - RNA, 145 nt, unidentified
  source 1..145: mol_type = other RNA; note = Related to JADKAD010000001.1; note = Deltaproteobacteria bacterium
cccgagctggtccacgcgacctccgtggggcaaccccacggcatcgtacttgcctcgtcactcggggggagacggaccgccgggatcgctcccggcgcgcgcctgtcggcgcttcacgtctcccagcacggagattcgtcgggcg

SEQ ID NO: 18060 - RNA, 138 nt, unidentified
  source 1..138: mol_type = other RNA; note = Related to JACMJN010001335.1; note = Deltaproteobacteria bacterium
accgaagcctaggcgtttcgacgccgcttccggggttaccccggggagaacctctcgacccgatcatcacggagcatgaccccgctccgcctgcgccctgcgcaggactggtcatgccgtagcggagcacgtcggtcg

SEQ ID NO: 18061 - RNA, 134 nt, unidentified
  source 1..134: mol_type = other RNA; note = Related to NZ_NGFO01000034.1; note = Gordonia lacunae
ggtgagaggggatcgtcgcgatccgtctcaggggtaacccctgggtgcacttcacagttggttcctgcgtccgacgccggcgcgcacgcttcacgtgccacccggcgccgttgcaccacagctctggtcaccac

SEQ ID NO: 18062 - RNA, 131 nt, unidentified
  source 1..131: mol_type = other RNA; note = Related to NZ_CP095552.1; note = Gordonia hongkongensis
ggtgagagtggatcgtcgcgatccgtctcaggggtaacccctgggtgcacttcacagctggtccctgcgtccgacgccggcgcgcacgctgcacgtgccacacggcgccgctgcacagttctggtcacccc

SEQ ID NO: 18063 - RNA, 134 nt, unidentified
  source 1..134: mol_type = other RNA; note = Related to NZ_JAKOIW010000003.1; note = Gordonia sp.
ggtgagaggggatcgtttcgatccgtctcaggggtaacccctgggtgcagtccacagttggttcctgcgtccgacgccggcccgcacgctgcacgtgctccacggcgccgcggcaccacggttctggtcaccac

SEQ ID NO: 18064 - RNA, 134 nt, unidentified
  source 1..134: mol_type = other RNA; note = Related to RKME01000013.1; note = Gordonia sp.
ggtgagagtggatcgtttcgatccgtctcaggggtaacccctgggtgcagttcacagttggttcctgcgtccgacgccggcgcgcacgctgcacgtgccacccggcgccgcgacaccaccgttctggtcgccac

SEQ ID NO: 18065 - RNA, 134 nt, unidentified
  source 1..134: mol_type = other RNA; note = Related to NZ_SLVY01000022.1; note = Rhodococcus sp.
ggtgagagcggatcgtttcggtccgtctcaggggaaacccctgggtacagttcacagttggttcctgcgtccgacgccgcaccgcacgctgcgcgtgccgaacggcgccgcgaccacgaggttcaggtcacctc

SEQ ID NO: 18066 - RNA, 134 nt, unidentified
  source 1..134: mol_type = other RNA; note = Related to NZ_FTNT01000002.1; note = Williamsia sterculiae
ggtgagagtggatcgtcacgatccgtctcaggggtaacccctgggtgcacctcacagttggtccctgcgtccgacgccggccggcacgctgcgcgtgcaccacggcgccgcgagaacgagttctgggtcaccgc

SEQ ID NO: 18067 - RNA, 134 nt, unidentified
  source 1..134: mol_type = other RNA; note = Related to JAADZU010000055.1; note = Gordonia desulfuricans
ggtgagaggggatcggttcgatccgtctcaggggaaacccctgggtacatgtcacagttggttcctgcgtccggcgccacacggcacgctccgcgtgcgacccggcgccgcggcactgcgttctgggtcactgc

SEQ ID NO: 18068 - RNA, 131 nt, unidentified
  source 1..131: mol_type = other RNA; note = Related to CP003119.1; note = Gordonia polyisoprenivorans
ggtgagaggggatcggttcgatccgtctcaggggtaacccctgggtacagttcacagttgggccctgcgtccgacgccgtgcagcacgctgcacgtgcaggccggcgccgcatcaaggttctggtcaccac

SEQ ID NO: 18069 - RNA, 132 nt, unidentified
  source 1..132: mol_type = other RNA; note = Related to BAFC01000046.1; note = Gordonia sputi
ggtgagagtggatcgagagatccgtctcaggggcaacccctgggtacacatcacagttggttcctgcgtccgacgccgctccgcacgctgcgcgtgccagccggcgacgagtactcggctcgtggtcacccc

SEQ ID NO: 18070 - RNA, 129 nt, unidentified
  source 1..129: mol_type = other RNA; note = Related to NZ_BANR01000005.1; note = Gordonia aichiensis
ggtgagagtggatcgagagatccgtcccaggggcaacccctgggtacatgtgacagttggttcctgcgtccgacgccggtccgcacgctgcgcgtgccgggcggcgacgagcactcggctcgtggtcac

SEQ ID NO: 18071 - RNA, 132 nt, unidentified
  source 1..132: mol_type = other RNA; note = Related to NZ_CP085974.1; note = Gordonia otitidis
ggtgagtgtggatcgagagatccgtctcaggggcaacccctgggtacatgtcacagttggttcctgcgtccgacgccgctccgcacgctgcgcgtgccagacggcgacgagtgttcggctcgtggtcgcccc

SEQ ID NO: 18072 - RNA, 134 nt, unidentified
  source 1..134: mol_type = other RNA; note = Related to NZ_BANX01000005.1; note = Gordonia soli
ggtgagggtggatcggtccgatccgtctcaggggtaacccctgggttcatcacacagttggtccctgcgtccgacgccacgccgcacgctgcgcgtgctacccggcgccgcgatcacgcgttcgaggtcaccgc

SEQ ID NO: 18073 - RNA, 134 nt, unidentified
  source 1..134: mol_type = other RNA; note = Related to NZ_AGFF01000003.1; note = Dietzia alimentaria
ggtgagagtggatcgatccgatccgtctcaggggcaacccctgggtacacatcacagcaagttcctgcgtccggtgccgcacggcacgctccgcgtgcgcaacggcaccgccaagacgagttccaggtcacctc

SEQ ID NO: 18074 - RNA, 134 nt, unidentified
  source 1..134: mol_type = other RNA; note = Related to NZ_CP046569.1; note = Dietzia sp.
ggtgagagtggatcgatccgatccgtctcaggggcaacccctgggtacacatcacagcaagttcctgcgtccggtgccgcacggcacgctccgcgtgcgcaacggcaccgccaagacgagctccaggtcacctc

SEQ ID NO: 18075 - RNA, 134 nt, unidentified
  source 1..134: mol_type = other RNA; note = Related to NZ_CP046567.1; note = Dietzia sp.
ggtgagggtggatcgatccgatccgtctcaggggcaacccctgggtgcacatcacagcgagacactgcgtccggcgccgtgcggcacgctccgcgtgcgcgacggcaccgcagagacgaacgtcgggtcacctc

SEQ ID NO: 18076 - RNA, 134 nt, unidentified
  source 1..134: mol_type = other RNA; note = Related to NZ_NTGA01000019.1; note = Dietzia natronolimnaea
ggtgagagtggatcgatccgatccgtctcaggggcaacccctgggtgcacatcacagcgagaccctgcgtctggtgtcgcgcggcacgctccgcgtgcaggacgacaccaccagaacgagcgtcaggtcgcctc

SEQ ID NO: 18077 - RNA, 134 nt, unidentified
  source 1..134: mol_type = other RNA; note = Related to DWWP01000013.1; note = Candidatus Dietzia intestinipullorum
ggcgagagtggatcgatcctatccgtcccaggggcaacccctgggtgcacatcacagcgagttcctgcgtccggagccgccgggcacgctccgcgtgcgacccggcaccgccgagacgagttcccggtcgcctc

SEQ ID NO: 18078 - RNA, 134 nt, unidentified
  source 1..134: mol_type = other RNA; note = Related to NZ_JAIFXZ010000017.1; note = Dietzia aurantiaca
ggcgagagtggatcgatccgatccgtctcaggggcaacccctgggtacacatcacagttagttcctgcgtccggtgccgcacggcacgctccgcgtgcgaatcggcaccgccgagacgagttcagggtcgcctc

SEQ ID NO: 18079 - RNA, 134 nt, unidentified
  source 1..134: mol_type = other RNA; note = Related to DWWG01000159.1; note = Candidatus Dietzia intestinigallinarum
ggcgagagtggatcgattcgatccgtctcaggggcaacccctgggtgcacatcacaaccgggcactgcgtccggagccgcacggcacgctccgcgtgcgcatcggcaccgccgagacgagttcagggtcgcctc

SEQ ID NO: 18080 - RNA, 134 nt, unidentified
  source 1..134: mol_type = other RNA; note = Related to DXGN01000154.1; note = Candidatus Dietzia merdigallinarum
ggcgagagtggatcgatccgatccgtctcaggggcaacccctgggtacacaccacagctggcatctgcgtccggtgccgcacggcacgcttcgcgtgcgaatcggcaccgccgagacgagttcagggtcgcctc

SEQ ID NO: 18081 - RNA, 132 nt, unidentified
  source 1..132: mol_type = other RNA; note = Related to JAKWBF010000007.1; note = Gordonia sp.
ggcgagagtggatcaatcgatccgtctcaggggcaacccctgggtacattccacagttggtctctgcgtccgacgccggacggcacgcttcgcgtgcttcacggcgccgctgctgcacgttccggtcatccc

SEQ ID NO: 18082 - RNA, 133 nt, unidentified
  source 1..133: mol_type = other RNA; note = Related to CP045804.1; note = Gordonia amarae
tgtgagagtggatcgagagatccgtctcaggggtaacccctgggtgcagttcacagcaagaccccgcggccggagccacgccgcacgctgtgcgtgccggatggcaccgcgaacaccggtgtgaggtcacagc

SEQ ID NO: 18083 - RNA, 133 nt, unidentified
  source 1..133: mol_type = other RNA; note = Related to NZ_BMCS01000002.1; note = Williamsia phyllosphaerae
gatgagagtgggtcgtcacgacccgtctcaggggtaacccctgggtacacctcacagttggtccctgcgtccgacgccatgcggcacgctgcgcgtgcttcgcggcgccgcgatacgagttctcggtcacctc

SEQ ID NO: 18084 - RNA, 133 nt, unidentified
  source 1..133: mol_type = other RNA; note = Related to NZ_RBKV01000001.1; note = Williamsia muralis
ggcgagagtgggttctccgaacccgtctcaggggcaacccctgggtacatctcacagttggtatcagcgtccgacgccggcaggcacgctccgcgtgctacacggcgccgcagacgagagttctggtcgcccc

SEQ ID NO: 18085 - RNA, 134 nt, unidentified
  source 1..134: mol_type = other RNA; note = Related to NZ_JAFRDR010000008.1; note = Williamsia soli
ggtgagagtgggttcttcgaacccgtctcaggggcaacccctgggtacatctcgcagttggtatcagcgtccgacgccgctccgcacgctccgcgtgccagccggcgccgccgacacaagctcgtggtcacctc

SEQ ID NO: 18086 - RNA, 132 nt, unidentified
  source 1..132: mol_type = other RNA; note = Related to NZ_CP011853.1; note = Gordonia phthalatica
tgcgagaggggtcgatcgacccgtctcgggggctacccccgggtgcatccacggtgagttctcgcgtcgcgcgcaggacggcacactccgtgtgcgccactgcgcgccgatgacgacaggtctggtcgcacc

SEQ ID NO: 18087 - RNA, 138 nt, unidentified
  source 1..138: mol_type = other RNA; note = Related to JAAYXO010000187.1; note = Gordonia sp.
cgggagggcggtgcgagaggggtctctcgatccgtctcaggggctacccctgggtgcattcacagttcggcagtgcgtcgcgcgcaggccggcacactccgtgtgcgacactgcgcgccgaagacgacaagtctgggt

SEQ ID NO: 18088 - RNA, 132 nt, unidentified
  source 1..132: mol_type = other RNA; note = Related to BAOP01000031.1; note = Gordonia malaquae
cgcgagagggatcgatgatccgtctcaggggctacccctgggttcatgcactgcacggcaccgcgtcgcacgcaggtcggcacacttcgtgtgcttcactgcgcgccgaggacgacaagtccaggtcgcgtc

SEQ ID NO: 18089 - RNA, 132 nt, unidentified
  source 1..132: mol_type = other RNA; note = Related to NZ_JACIFP010000001.1; note = Gordonia humi
cgcgagagggatcgatgatccgtctcaggggcatcccctgggttcatgcacggcacggcttcgcgtcgcgcgcagacgggcacactccgtgtacggcgctgcgcgccgagaacgacatgttctggtcgcgcc

SEQ ID NO: 18090 - RNA, 138 nt, unidentified
  source 1..138: mol_type = other RNA; note = Related to NZ_JABBNB010000006.1; note = Gordonia asplenii
gacgagagcgggggatcgcgagatcctcggtctcaggggctacccctgggttcatgcacagcgtgacatcacgtcccgcgcagccgagcacactgcgtgtgcaaccctgcgcggcggacgacaggtttcggtcgtccc

SEQ ID NO: 18091 - RNA, 134 nt, unidentified
  source 1..134: mol_type = other RNA; note = Related to JAHCSG010000002.1; note = Williamsia sp.
ggtgagagtggatcctcgcgatccgtctcaggggcaacccctgggttcagaccacagctacaccctgcgtccgacgccaccgggcacgctgcgcgtgcttcatggcgccgcgatgacgagttgacggtcaccct

SEQ ID NO: 18092 - RNA, 133 nt, unidentified
  source 1..133: mol_type = other RNA; note = Related to NZ_JXYP01000014.1; note = Williamsia herbipolensis
gacgagaacggggtgacacacccgtctcaggggcaacccctgggtacaccacacagcgagaccctgcgtccgacgccggaccgcacgctgcgcgtgcatcgcggcgccgaggacaggagaattcggtcgactc

SEQ ID NO: 18093 - RNA, 134 nt, unidentified
  source 1..134: mol_type = other RNA; note = Related to NZ_AUFT01000012.1; note = Nakamurella lactea
ggcgagagtgggtcgatgcgacccgtctcaggggtaacccctgggtgcagttcacagttggtatcagcgtccgacgccggaccacatgcttcgcgtgtccggcggcgccgcggacaggtgcggttggtcgcccc

SEQ ID NO: 18094 - RNA, 141 nt, unidentified
  source 1..141: mol_type = other RNA; note = Related to JABEND010000002.1; note = Nakamurella aerolata
ggcgagaacgggtacggcatcgctgtgccctggtcaggggaaacccctggcgaggcgagacagttgcaccacgcatccggcgccgccgcggcccgctccgcgggcgaaggggcgccgcgaacagcaggaactggtcgaccc

SEQ ID NO: 18095 - RNA, 134 nt, unidentified
  source 1..134: mol_type = other RNA; note = Related to NZ_CP070357.1; note = Tsukamurella tyrosinosolvens
ggtgaggtgggatccgcgagatccgtcccagcggtaaccgctgggggcactgcacagttacaccctgcgtcccacgccggcgcgtgcgctccgcgcaccacacggcgctccggggccttgttccaggtcacccg

SEQ ID NO: 18096 - RNA, 134 nt, unidentified
  source 1..134: mol_type = other RNA; note = Related to NZ_VIGX01000010.1; note = Tsukamurella conjunctivitidis
ggtgaggcgggatccgcgcgatccgtcccagcggtaaccgctgggagcactgcacagtcactccctgcgtcccgcgccggcctgtgcgcttcgcgcacctcgcggcgctccgggactctgttccaggtcacccg

SEQ ID NO: 18097 - RNA, 134 nt, unidentified
  source 1..134: mol_type = other RNA; note = Related to NZ_UHII01000001.1; note = Tsukamurella pulmonis
ggtgaggtgggatccacgcgatccgtctcagcggcaaccgctgggggcactgcacagtcacaccccgcgtcccacgccggacggtgcgctgcgcgcacgcgacggcgctccgggaacatgtttcaggtcacccg

SEQ ID NO: 18098 - RNA, 134 nt, unidentified
  source 1..134: mol_type = other RNA; note = Related to JAIULG010000072.1; note = Tsukamurella sp.
ggcgaggagggatcctcgcgatccgtcccagcggtaaccgctgggggcaccgcacagtcacaccctgcgtcccacgccggcgcgtgcgctgcgcgcaccacacggcgctccgggaccttgttccaggtcacccg

SEQ ID NO: 18099 - RNA, 134 nt, unidentified
  source 1..134: mol_type = other RNA; note = Related to AP025688.1; note = Tsukamurella sp.
ggtgaggcgggatccatgcgatccgtcccagcggtaaccgctgggggctctgcacagctacacctcgcgtcccacgccggtcagtgcgctgcgcgcaccagacggcgctccgggaactcgttccaggtcacccg

SEQ ID NO: 18100 - RNA, 134 nt, unidentified
  source 1..134: mol_type = other RNA; note = Related to NZ_LSRF01000001.1; note = Tsukamurella pseudospumae
ggtgaggtgggatccttgcgatccgtcccagcggcaaccgctgggggctctgcacagttacaccccgcgtcccacgccggtccgtgcgctccgcgcaccgggcggcgctccgggcgagtgtttcaggtcacccg

SEQ ID NO: 18101 - RNA, 134 nt, unidentified
  source 1..134: mol_type = other RNA; note = Related to CP001966.1; note = Tsukamurella paurometabola
ggggaggcgggatccgcgcgatccatcccagcggtaaccgctgggcgcaccacacggctacaccacgcgtcccacgccggacggggcgctacgcgccctcctcggcgctgcgggcgactgtttcaggtccgccg

SEQ ID NO: 18102 - RNA, 134 nt, unidentified
  source 1..134: mol_type = other RNA; note = Related to BPMV01000001.1; note = Tsukamurella sp.
ggggaggcgggatccgcgcgatccatcccagcggtaaccgctgggtgcaccacacggctacacctcgcgtcccacgccggcccgggcgcttcgcgcccctcgcggcgctgtgggcgattgtttctggtcacccg

SEQ ID NO: 18103 - RNA, 147 nt, unidentified
  source 1..147: mol_type = other RNA; note = Related to NZ_CP070609.1; note = Rhodococcus koreensis
ggtgagagtggtgtggccggttcgccgaccgcgaccacgtcaggggtaacccctggctcgacagtgttcaccggagacaccgtccgacgcgcgaccgcatgctccgcgtgctccggcgcgccgcagacgacaggtatcggtcacctc

SEQ ID NO: 18104 - RNA, 147 nt, unidentified
  source 1..147: mol_type = other RNA; note = Related to CP003949.1; note = Rhodococcus opacus
ggtgagagtggtgtggccggttcgccggccgcgaccacgtcaggggaaacccctggctcgacagtgttcatcggagacaccgtccgacgcgcgaccgtatgctccgcgtgcttcggcgcgccgcagacgacagatatcggtcacctc

SEQ ID NO: 18105 - RNA, 147 nt, unidentified
  source 1..147: mol_type = other RNA; note = Related to NZ_CP058638.1; note = Rhodococcus sp.
ggtgagagtggggtggccggtacgccggctgcgaccacgtcaggggtaacccctggctcggcattgttcaccggaggcaccgtccgacgcacgaccgcacgctccgcgtgcttcggcgcgccgcagacgacaggtatcggtcgcctc

SEQ ID NO: 18106 - RNA, 145 nt, unidentified
  source 1..145: mol_type = other RNA; note = Related to NZ_VLNY01000005.1; note = Rhodococcus cavernicola
ggcgagtggtgcagccggttcgccggttgtggccgcgtcaggggtaacccctggcttgtcagtatcagccggacgcaccgtccgacgcacgaccgcacgcttcgcgtgcctgagtgcgccgcagacgacagttatcggtcgcccc

SEQ ID NO: 18107 - RNA, 141 nt, unidentified
  source 1..141: mol_type = other RNA; note = Related to JACHWS010000003.1; note = Hoyosella altamirensis
cgcgagagtgggagggctgtcgccctttccatgtccggggtaaccccgggctgcgcgttgcaagttgggcacatcgtccgacgcacttcggcacgctccgcgtgcgcccgtgcgccgctgacgacaggttatggtcgcgcc

SEQ ID NO: 18108 - RNA, 141 nt, unidentified
  source 1..141: mol_type = other RNA; note = Related to NZ_QRCM01000001.1; note = Rhodococcus rhodnii
cgcgagagcggatcggccgattcgtcggcacgatccgggtcaggggcaacccctggcacacggatatcggcagggcacaccgtccgacgcactcccgcgcgctccgcgcgccaccgtgcgccgcagacgacaggtctcggt

SEQ ID NO: 18109 - RNA, 138 nt, unidentified
  source 1..138: mol_type = other RNA; note = Related to NZ_CP018082.1; note = Nocardia mangyaensis
agcgagagtggggttgaaaggcgacccatctcaggggtaacccctgggggcttcttgtcggttgggtacagcgtccggagcaagggcgcacgcttcgcgtgcagcgcagcaccgtggacgaaggattctggtcgctcc

SEQ ID NO: 18110 - RNA, 135 nt, unidentified
  source 1..135: mol_type = other RNA; note = Related to NZ_BDBG01000003.1; note = Nocardia salmonicida
ggcgagagcgggtcgggtcgacccacctcaggggtaacccctgggagcgtcttgtcagttgggctcagcgtccggagcaagggcgcacgcttcgcgtgcctcgcagcaccgcggacgaaggattctggtcgcccc

SEQ ID NO: 18111 - RNA, 135 nt, unidentified
  source 1..135: mol_type = other RNA; note = Related to NZ_JACVEE010000002.1; note = Nocardia sp.
ggcgagtgtgggtcgatgcgacccgtctcaggggtaacccctgggtcaggcaggtcagttgggcacagcgtccgaaaccacagggcacgctccgcgtgcatcttggtacgaaggacgaagggttctggtcgcctc

SEQ ID NO: 18112 - RNA, 135 nt, unidentified
  source 1..135: mol_type = other RNA; note = Related to NZ_JAGGMR010000001.1; note = Nocardia goodfellowii
ggcgagagtgggtcgaagcgacccgtctcaggggaaacccctgggtcaggcagatcagttgggcacagcgtccgaaaccaccgggcacgctccgcgtgcgtcctggtacggaggacgaagggttctggtcgcctc

SEQ ID NO: 18113 - RNA, 135 nt, unidentified
  source 1..135: mol_type = other RNA; note = Related to NZ_BAGK01000206.1; note = Nocardia thailandica
ggtgagagcgggtcggtaggacccacctcaggggcaacccctgggaacgacacatcgatcgggtacagcgtccggagccggcgcgcacgcaccgagtgcctcgcggcaccgcggacgagagatttcggtcgccac

SEQ ID NO: 18114 - RNA, 135 nt, unidentified
  source 1..135: mol_type = other RNA; note = Related to NZ_BDAY01000016.1; note = Nocardia altamirensis
ggcgagagtgggtcgatcgggcccgtctcaggggtaacccctgggggcatttcagcagttgggttcagcgtccgaagccgctccgcacgctccgcgtgccggccggcgccgaggacgagagattgtggtcgcccc

SEQ ID NO: 18115 - RNA, 135 nt, unidentified
  source 1..135: mol_type = other RNA; note = Related to NZ_JAEMNV010000003.1; note = Antrihabitans stalagmiti
ggcgagagtgggtcgatcggacccgtctcaggggcaacccctgggtatgacagatcagttgggcactgcgtccgaagccggcccgcgcgctccgcgcgcatcgcggcgccgaggacgaaggattcaggtcgcccc

SEQ ID NO: 18116 - RNA, 132 nt, unidentified
  source 1..132: mol_type = other RNA; note = Related to NZ_BCRU01000034.1; note = Smaragdicoccus niigatensis
ggtgagcgaggaccgagaaggtctgtctcaggggtaacccctgggtgcgtcgaatcagttggcaacagcgtccgaagccgctgggcacgctccgcgtgcggcccggcgacaaagacaagagcaggtcgtcgg

SEQ ID NO: 18117 - RNA, 135 nt, unidentified
  source 1..135: mol_type = other RNA; note = Related to VLIY01000014.1; note = Skermania sp.
ggcgagcgtgggtcgatcaggccctcctcaggggcaacccctgggtgcacatcatcagttgggcacagcgtccggagccgctcggcgcgctgcgcgagctacacggcgccaaggacgatagtttttggtcgcccc

SEQ ID NO: 18118 - RNA, 136 nt, unidentified
  source 1..136: mol_type = other RNA; note = Related to JAFBBK010000001.1; note = Rhodococcus corynebacterioides
ggcgagagtgggtcctgcgcgaccctcctcgagggcaaccctcgggaacgatcacggaatcgggcactgcgtccgacgcacctcggcacgctccgcgtgctggagcgcgacgacgacgagagtctcaggtcgcctc

SEQ ID NO: 18119 - RNA, 136 nt, unidentified
  source 1..136: mol_type = other RNA; note = Related to LMRP01000002.1; note = Rhodococcus sp.
ggcgagagtgggtcctgcgagacccgactcgagggaaaccctcgggaacattcacagaaccggtcactgcttccgacgcgcccgagcacgctccgcgtgcctccgcgcgacgacgacgacagtcttcggtcgcccc

SEQ ID NO: 18120 - RNA, 151 nt, unidentified
  source 1..151: mol_type = other RNA; note = Related to JABUBR010000003.1; note = Rhodococcus corynebacterioides
ggcgagagtggggtcgaccggagttcgcggccggtcacccgtctcgggggcaacccccgggtacgagaacacagccgatcactgcgtccgacgcaggaatgcacgctccgcgtgctgcgctgcgccgccgacgggagagcatggtcgcccc

SEQ ID NO: 18121 - RNA, 142 nt, unidentified
  source 1..142: mol_type = other RNA; note = Related to NZ_BMCU01000001.1; note = Rhodococcus trifolii
ggcgagagcgggtctgccaccatcgaggcccatctcaggggtaacccctggggcgaacatcttcatcggtcactgcgtccgaagcaggagtgcacgctccgcgtgctgcgctgctccgcggacggaagaagcaggtcgcccc

SEQ ID NO: 18122 - RNA, 135 nt, unidentified
  source 1..135: mol_type = other RNA; note = Related to NZ_CP032762.1; note = Rhodococcus sp.
ggcgagagttggtccgctgggccgatcccaggggtaacccctgggcgagagagaagaactgggcactgcgtccgatgccggtccgcacgctccgcgtgcttgacggcgccgagtacgaaagattcaggtcgcccg

SEQ ID NO: 18123 - RNA, 135 nt, unidentified
  source 1..135: mol_type = other RNA; note = Related to NZ_NPFR01000010.1; note = Rhodococcus sp.
ggcgagagtcggtccgctgggccgatctcaggggtaacccctgggcgagacagaagaactggtcactgcgtccgacgccggtccgcacgctccgcgtgctcggcggcgccgagtacacaagattcaggtcgcccg

SEQ ID NO: 18124 - RNA, 135 nt, unidentified
  source 1..135: mol_type = other RNA; note = Related to NZ_LVCV01000404.1; note = Rhodococcus sp.
ggcgagtgtcggtccgcgcgaccgatctcaggggcaacccctgggtgggaaagaagaactgggcactgcgtccgacgccggtccgcacgctccgcgtgcacgacggcgccgagcacgaaagattcaggtcgcccg

SEQ ID NO: 18125 - RNA, 135 nt, unidentified
  source 1..135: mol_type = other RNA; note = Related to NZ_JABFAO010000002.1; note = Rhodococcus sp.
ggtgagagttggtccgaagggccgatcccaggggcaacccctgggcgagaaagaagaactgggcactgcgtccgacgccgctccgcacgctccgcgtgcacgccggcgccgagtacgaaagattcaggtcacccg

SEQ ID NO: 18126 - RNA, 135 nt, unidentified
  source 1..135: mol_type = other RNA; note = Related to LVHI01000032.1; note = Rhodococcus kyotonensis
ggcgagagttggtccgcgcgaccatcctcaggggtaacccctgggtgtgagagaacaaccggtcactgcgtccgacgccgctccgcacgctccgcgtgccagacggcgccgagtacgaaagtttcaggtcgcccg

SEQ ID NO: 18127 - RNA, 135 nt, unidentified
  source 1..135: mol_type = other RNA; note = Related to NZ_CP010797.1; note = Rhodococcus sp.
ggcgagagttggtccgcgggaccggtctcaggggtaacccctgggtacatcacgagaatcgagcactgcgtccgaagctggtctgcacgctccgcgtgcttggcagctccgaggacgaaagatttcggtcgcccc

SEQ ID NO: 18128 - RNA, 135 nt, unidentified
  source 1..135: mol_type = other RNA; note = Related to NZ_JABFAU010000077.1; note = Rhodococcus sp.
ggcgagagttggtccgtagggccggtctcaggggcaacccctgggtgcatcacgagaatcgatcactgcgtccgaagcagctctgcacgcttcgcgtgctcgactgctccgaggacgaaagatttcggtcgcccc

SEQ ID NO: 18129 - RNA, 135 nt, unidentified
  source 1..135: mol_type = other RNA; note = Related to CP015235.1; note = Rhodococcus fascians
ggcgagagttggtccgcgggaccggtctcaggggtaacccctgggtacatattgagaatcgagcactgcgtccgaagcagctccgcacgctacgcgtgcccgactgctccgaggacgaaagatttcggtcgcctc

SEQ ID NO: 18130 - RNA, 135 nt, unidentified
  source 1..135: mol_type = other RNA; note = Related to NZ_CP039254.1; note = Rhodococcus sp.
ggcgagagttggtccgtgcgaccaagctcaggggtaacccctgggagagaattgagaatcggtcactgcgtccgaagcagctcggcacgctccgcgtgcttgactgctccgaggacgaaagatttcggtcgcccc

SEQ ID NO: 18131 - RNA, 134 nt, unidentified
  source 1..134: mol_type = other RNA; note = Related to NZ_CP007255.1; note = Rhodococcus erythropolis
ggtgagagttggtccacgcgaccagtctcaggggtaacccctgggtcggccagaagaattggatactgcgtccaccggcgttcggcacgctccgcgtgcttgccgccgcaccggacaaaggatttggtcacccc

SEQ ID NO: 18132 - RNA, 149 nt, unidentified
  source 1..149: mol_type = other RNA; note = Related to JAGRPD010000186.1; note = Verrucomicrobiales bacterium
ccccagcctgactccgaagtgagcccacgcttccttcgcggtccgtccggggcatccccgggctgcatgaaacacctcaccataccgtcgcgccagcccctccgcgctccacgcggcacggctgcgcgcacaacgggcttcgtgggggc

SEQ ID NO: 18133 - RNA, 149 nt, unidentified
  source 1..149: mol_type = other RNA; note = Related to JAJTHZ010000014.1; note = Xanthomonadaceae bacterium
cccgagttcatgccgtgatcgatgcgtaacgtcgaatccggccgccgcggggtttccccgcggtgagacaccgcacatcgggctctacatggcagcgacgtacctgcgacacgtcgcagagcggtcgccgcagacgaagacgtcggggc

SEQ ID NO: 18134 - RNA, 139 nt, unidentified
  source 1..139: mol_type = other RNA; note = Related to NZ_JACCBH010000001.1; note = Microbacterium pseudoresistens
gacgaggcgggtggtacacgcgttgtcccgccctctccggggctaccccggggtacgcaggctgatcaggaacgaccgccgcaggcacctcactgcgcttcgcgcagaccggcgcccgcactgatggacgagtcgtccg

SEQ ID NO: 18135 - RNA, 139 nt, unidentified
  source 1..139: mol_type = other RNA; note = Related to NZ_BMCM01000001.1; note = Microbacterium murale
gacgaggcgagtggttcacgatgtgttccgctctctccggggtcaccccggggtacgcagtctgacctggaacgaacgccgcaggcgcctccttgcgcttcgcgcaatacagcgcccgcactgatggatgagtcgtacg

SEQ ID NO: 18136 - RNA, 139 nt, unidentified
  source 1..139: mol_type = other RNA; note = Related to NZ_PCOT01000008.1; note = Microbacterium sp.
agcgagacgggtggttcacgcggtgagccatcctctccggggataccccggggcacgcaggccgatctggaacgaacgccgcaggcgcctccctgcgcttcgcgcagtacagcgcccgcactgatggacgagtcgcgcg

SEQ ID NO: 18137 - RNA, 139 nt, unidentified
  source 1..139: mol_type = other RNA; note = Related to NZ_JAFBBQ010000001.1; note = Microbacterium keratanolyticum
gacgaggcgggtggttcacgaggtgttccatcctctccggggataccccggggcacgcaggctgagctgacagaaacgccgcaggcgcctccctgcgcttcgcgcagtacagcgcccgcactgatggacgagtcgtgcg

SEQ ID NO: 18138 - RNA, 139 nt, unidentified
  source 1..139: mol_type = other RNA; note = Related to NZ_CP035375.1; note = Salinibacterium sp.
gtcgaggcggatggagcgcgagccgttctatcctcttcggggataccccgaggtacgcagactgagttacgacacacgccgcgggcgcgccactgcgcttcgcgcagcaatgcgcccgcagtgacagacaggtcgatct

SEQ ID NO: 18139 - RNA, 139 nt, unidentified
  source 1..139: mol_type = other RNA; note = Related to LMDN01000001.1; note = Leifsonia sp.
gacgaggtgggtggtgcacgagctgttcctccctctccggggctaccccggggcacgcagaccgagatgagacaaacaccgtcggcaccacgctgcgctccgcgcagctccgtgccgacaccgatcgacgagtcgtccg

SEQ ID NO: 18140 - RNA, 139 nt, unidentified
  source 1..139: mol_type = other RNA; note = Related to NZ_JPRS01000007.1; note = Cryobacterium sp.
ggcgaggtggatggtgcatgcgttgtaccgtcctctccggggataccccggggcacgaagatcgactgtgaacgaccgccgcaggcgcatttctgcgctccgcgcagccccgcgcctgcactgagagacgagtcgtccg

SEQ ID NO: 18141 - RNA, 139 nt, unidentified
  source 1..139: mol_type = other RNA; note = Related to NZ_PJJO01000056.1; note = Cryobacterium sp.
ggcgaggcgggtggtacacgcgttgtgctgccttctccggggctaccccggggcacgaaggtcatctgtgaacgagcgccgcaggcgcgtctctgcgctccgcgcagcacggcgcctgcacgaagggacgagtcgcccg

SEQ ID NO: 18142 - RNA, 139 nt, unidentified
  source 1..139: mol_type = other RNA; note = Related to NZ_JACHBQ010000001.1; note = Cryobacterium roopkundense
ggcgaggcgggtagtgcacgtgatgtgctgccctctccggggttaccccggggcacgaagaccgacctggaacgagcgccgcaggcgcgtctctgcgctccgcgcagctcggcgcctgcacccagtgacgagtcgcccg

SEQ ID NO: 18143 - RNA, 139 nt, unidentified
  source 1..139: mol_type = other RNA; note = Related to NZ_QZVS01000068.1; note = Cryobacterium melibiosiphilum
ggcgaggcgggtggtgcacgcgttgcgccgccctctccggggctaccccggggcacgcagaccgaccaggacagaccaccgcaggcacgccactgcgctccgcgcagctcggtgcccgcaccgatggacgagtcgcccg

SEQ ID NO: 18144 - RNA, 139 nt, unidentified
  source 1..139: mol_type = other RNA; note = Related to SOHE01000083.1; note = Cryobacterium sp.
ggcgaggcgggtggtgcacgcgttgcgccgccctctccggggctaccccggggcacgcagaccgaccaggaacgaacaccgcaggcacgccactgcgctccgcgcagctcggtgcccgcaccgatcgacgagtcgcccg

SEQ ID NO: 18145 - RNA, 139 nt, unidentified
  source 1..139: mol_type = other RNA; note = Related to NZ_JAALGE010000001.1; note = Marisediminicola senii
aacgaggtggcaggtacccgagcggtgcccgcctctccggggttaccccggggcacgcaggccgagatggaacgagcgccgcgggcgcggccctgcgcttcgcgcagccgtgcgcccgcacgaacggacgagtcgtccg

SEQ ID NO: 18146 - RNA, 139 nt, unidentified
  source 1..139: mol_type = other RNA; note = Microbacteriaceae bacterium VKM Ac-2855; note = Related to JABMLG010000003.1
cgcgaggcggacggtggcacgcgatgcaccgtcctctccggggctaccccggggcacgaagaccgactgagccacgcgacgcaggcgcctctctgcgcttcgcgcagccgagcgcccgcactgatcgacaggtcgcgcg

SEQ ID NO: 18147 - RNA, 138 nt, unidentified
  source 1..138: mol_type = other RNA; note = Microbacteriaceae bacterium VKM Ac-2854; note = Related to JABMLH010000001.1
ggcgaggcggatcggcgcacgatgtgcgtcgtcctccccggggccaccccggggcacgaagaccgacggagagacgcggcgctgcgccacgctgcgcttcgcgcaggcgagcgcacgcacggagagacaggtcgcgcg

SEQ ID NO: 18148 - RNA, 139 nt, unidentified
  source 1..139: mol_type = other RNA; note = Related to NZ_CP017146.1; note = Marisediminicola antarctica
gacgaggtgggtggcacacgcgatgcgccgccatctccggggataccccggggcacgaagaccgacctggaacgagcgccgcaggcgcctccctgcgctccgcgcagctcagcgcccgcactgaaggacgagtcgtccg

SEQ ID NO: 18149 - RNA, 139 nt, unidentified
  source 1..139: mol_type = other RNA; note = Related to NZ_CP095501.1; note = Arthrobacter sp.
gccgaggcgggacgcgtacgcagtgcgcgttcctctccggggcaaccccggggcacgcagaccgaccagcacagggcgcctcaggcgcccgcctgcgctccgcgcagctcagcgcccgaacagagggacaggtcggccg

SEQ ID NO: 18150 - RNA, 139 nt, unidentified
  source 1..139: mol_type = other RNA; note = Related to NZ_PRKW01000004.1; note = Arthrobacter pityocampae
gccgaggcgggccgcgtacgccgtgcgcggtcctctccggggctaccccggggcacgcagaccgaccggcacagggcacctcaggcgcccgactgcgctccgcgcagctcagcgcccgaacagagtggcaggtcggccg

SEQ ID NO: 18151 - RNA, 139 nt, unidentified
  source 1..139: mol_type = other RNA; note = Related to NZ_CP024915.1; note = Arthrobacter agilis
gccgaggcggaacacgtacgcagtgcgcgttcctctccggggtcaccccggggcacgcagaccgaccagcacagggcgcctcaggcgcctgactgcgctccgcgcagctcagcgcccgaacagaaggacaggtcggccg

SEQ ID NO: 18152 - RNA, 140 nt, Vibrio sp.
  source 1..140: mol_type = other RNA; note = Related to WNZI01000030.1; note = Vibrio cholerae
gccgaggcggagcacgtacaccgtgcgcgctcctctccggggttaccccggggcacgcagaccgaccagcacagggcgcctcaggcacctgactgcgcttcgcgcagctcagcgcccgaacagagagaacaggtcggccg

SEQ ID NO: 18153 - RNA, 139 nt, unidentified
  source 1..139: mol_type = other RNA; note = Related to LR131272.1; note = Arthrobacter agilis
gccgaggcggtgcgcgtacgcagtgcgcgctcctctccggggctaccccggggcacgcagaccgaccagcacacggcgcctcaggcacctgactgcgcttcgcgcagctcagcgcccgaacaggaggacaggtcggccg

SEQ ID NO: 18154 - RNA, 139 nt, unidentified
  source 1..139: mol_type = other RNA; note = Related to LMLU01000001.1; note = Arthrobacter sp.
gccgaggcgggccacgtacgcggtacgcggtcctctccggggataccccggggcacgcagaccgaccagcacagagcgcctcgggcacctgactgcgctccgcgcagctcagcgcccgaacaggacgacaggtcggccg

SEQ ID NO: 18155 - RNA, 139 nt, unidentified
  source 1..139: mol_type = other RNA; note = Related to LGIU01000097.1; note = Arthrobacter sp.
gccgaggcggagcacgcacgcggtgcgcgttcctctccggggctaccccggggcacgcagatcgaccagcacagggcgcctcgggcacctgactgcgctccgcgcagcacagtgcccgaacagcaggacaggtcggccg

SEQ ID NO: 18156 - RNA, 137 nt, unidentified
  source 1..137: mol_type = other RNA; note = Related to NZ_JAFMPX010000005.1; note = Arthrobacter sp.
gacgaggtggaactgcactcgtgcaggttcctccccggggctaccccggggcacgtagtaccgctcgagaaggcgccgcgggtgggggctctgcgctccgcgcagcacaccacccgcaccgacagacaggtcgtctg

SEQ ID NO: 18157 - RNA, 139 nt, unidentified
  source 1..139: mol_type = other RNA; note = Related to VFOO01000001.1; note = Subtercola boreus
gacgaggtggacggttcaggttctgatccgtcctctccggggtcaccccggggtacgcaggccgactcaggcacttcgccgcaggcgtctcaccgcacttcgagcggccgaacgcccgcacagacgcacaggtcgtctg

SEQ ID NO: 18158 - RNA, 139 nt, unidentified
  source 1..139: mol_type = other RNA; note = Related to NBXA01000026.1; note = Subtercola boreus
gacgaggtggacggttcacgacgtgatccgccctctccggggccaccccggggtacgcagaccgactcaggcacttcgccgcaggcgtctcaccgcacttcgagcggccgcacgcccgcacagacgcacaggtcgtctg

SEQ ID NO: 18159 - RNA, 139 nt, unidentified
  source 1..139: mol_type = other RNA; note = Related to NZ_NBXE01000029.1; note = Subtercola boreus
gacgaggtggatggttcagacgctgatccgtcctctccggggctaccccggggcacgcagatcgattccggcacgacgtcgcaggcgcctctccgcactccgagcggccgagcgcccgcgcttcagcacaggtcgtctg

SEQ ID NO: 18160 - RNA, 145 nt, unidentified
  source 1..145: mol_type = other RNA; note = Related to RCUY01000005.1; note = Mycetocola lacteus
gtcgagaacgggagggcacaccatgcgttgctcccttccgctccggggtaaccccggggaccgcaaaccgagtaccaccacgcgccccgagtgcccgccgacgcttcgcgtcgcaccgcacacggccgcctcaaccggtcgatcg

SEQ ID NO: 18161 - RNA, 144 nt, unidentified
  source 1..144: mol_type = other RNA; note = Related to NZ_RCUX01000009.1; note = Mycetocola tolaasinivorans
gtcgagaacggagggcgaaacatgcgtgattcccttccgctccggggtaaccccgggggccgcagaccgagcaggaccacgcgccccgagtgcctcccgacgcttcgcgtcgcaccgcacacggccgcatcgaccggtcgatca

SEQ ID NO: 18162 - RNA, 140 nt, unidentified
  source 1..140: mol_type = other RNA; note = Related to NZ_CP080203.1; note = Mycetocola spongiae
ggtgaggcgggtgatccacatcatggtgacatcctccccggggttaccccggggcacgcagtccgagctattatccacgcctcgggtgccccgcagcgcttcgcgcagcccggcatccgagaccagtgcagggtcaccgc

SEQ ID NO: 18163 - RNA, 140 nt, unidentified
  source 1..140: mol_type = other RNA; note = Related to CP007595.1; note = Arthrobacter sp.
gatgaggcgggaggcgtccttgggcgcgcatccctccccggggctaccccggggcacgaattattgcctgattcatgcaccgcaggtgcgtcactgcgctccgcgcagcagcgcacccgcacagacagccaggtcatcgg

SEQ ID NO: 18164 - RNA, 140 nt, unidentified
  source 1..140: mol_type = other RNA; note = Related to CP013200.1; note = Arthrobacter alpinus
gatgaggcgggaagcgtcctttggcgcgcgtccctctccggggctaccccggggtatgcagtattgcctgatccatgcaccgcgggtgcgtcactgcgctccgcgcagcagcgcacccgcacagacagccgagtcatcaa

SEQ ID NO: 18165 - RNA, 140 nt, unidentified
  source 1..140: mol_type = other RNA; note = Related to NZ_JAGIOI010000001.1; note = Arthrobacter stackebrandtii
gatgaggcgggaagcggcctttggcgcgcatccctccccggggctaccccggggcacgaaatattgcctgatccatgcaccgcaggtgcggcactgcgctccgcgcagctgcgcacccgcacagacagccgggtcatcgg

SEQ ID NO: 18166 - RNA, 140 nt, unidentified
  source 1..140: mol_type = other RNA; note = Related to NZ_QJVC01000003.1; note = Arthrobacter psychrolactophilus
gatgaggcgggaagcgtctttcggcgcccatccctccccggggttaccccggggcacgcagttttgcctgatccatgcacctcggatgcgtcgttgcgctccgcgcaactgggcaaccgaacagacagccaggtcatcgg

SEQ ID NO: 18167 - RNA, 140 nt, unidentified
  source 1..140: mol_type = other RNA; note = Related to NZ_CZJT01000056.1; note = Paeniglutamicibacter antarcticus
gatgaggtgggaagcgttatttagcgcgctttccgctccggggttaccccgggggacgcagtcttacctgattcaagcaccgtgggtgcctcgctgcgctccgcgcaggagcgcacccacaccgatagccgggtcatcga

SEQ ID NO: 18168 - RNA, 140 nt, unidentified
  source 1..140: mol_type = other RNA; note = Related to NZ_CP013745.1; note = Arthrobacter alpinus
gatgaggcgggaagcggcttttggcgcgcctccctccccggggctaccccggggtacgcagtattgcctgatcgaagcacctcgggtgcggcgctgcgctccgcgcagctcggcacccggacagagcgccaggtcatcga

SEQ ID NO: 18169 - RNA, 140 nt, unidentified
  source 1..140: mol_type = other RNA; note = Related to NZ_JAAWVT010000016.1; note = Paeniglutamicibacter terrestris
gatgaggtgggaagcgtcttttagcacgcgttcctctccggggataccccggggtacgcagtattgcctgatccatgcaccgcaggtgcgtctctgcgcttcgcgcagctcggcacccgcacagacagctaggtcatcgg

SEQ ID NO: 18170 - RNA, 139 nt, unidentified
  source 1..139: mol_type = other RNA; note = Related to NZ_JAJJBU010000018.1; note = Arthrobacter cryoconiti
gatgaggtgggtacggcacctagtgcgcgtccctctccggggttaccccggggcttgcacgtcaccctgagacatccgcctcgggtgcctcactgcgctccgcgcagcagcgcacccgaacagagagtgaagtcatcca

SEQ ID NO: 18171 - RNA, 138 nt, unidentified
  source 1..138: mol_type = other RNA; note = Related to NZ_JAAKZI010000011.1; note = Arthrobacter silviterrae
gatgaggcgggcgggcacctggtgcaccaccctctccggggttaccccgggggacgaagactggcctccagcatgcgcctcgggcgcctgtctgcgctccgcgcagctcagcgcccgaacagactgacaggtcatcca

SEQ ID NO: 18172 - RNA, 139 nt, unidentified
  source 1..139: mol_type = other RNA; note = Related to NZ_CP029642.1; note = Arthrobacter sp.
gatgaggcgggcgggcatcacggtgcaccaccctctccggggctaccccggaggacgaagactggcctccagcaagcgcctcgggcgccactctgcgctccgcgcagccgcgcgcccgaacagacagacaggtcatcca

SEQ ID NO: 18173 - RNA, 139 nt, unidentified
  source 1..139: mol_type = other RNA; note = Related to NZ_CP012479.1; note = Arthrobacter sp.
gatgaggtgggtgggcatttgcgtgccctgccctctccggggataccccgggggacgaagaacgacctcctgcaagcaccgcagccgcctcgcagcgctccgcgcagcagggcggccgcacagactgacgggtcatccg

SEQ ID NO: 18174 - RNA, 139 nt, unidentified
  source 1..139: mol_type = other RNA; note = Related to NZ_PPXB01000002.1; note = Arthrobacter glacialis
gatgagatggggagtcaccttggtgacccaccctctccggggctaccccgggggacgaagacgtacctccagcatgcgccttgggcgcgccgctacgctccgcgaagcgcggcgcccaaacagacagattggtcatcat

SEQ ID NO: 18175 - RNA, 139 nt, unidentified
  source 1..139: mol_type = other RNA; note = Related to NZ_KI519454.1; note = Arthrobacter sp.
gatgaggtgggcagtgccttgaaagcacttccctctccggggctaccccggggcacgcagttcgaccagcaccacgcgccgtgggcccgcccctgcgctccgcgcagcacggggcccacacagacagatgggtcatccg

SEQ ID NO: 18176 - RNA, 139 nt, unidentified
  source 1..139: mol_type = other RNA; note = Related to NZ_PJIO01000003.1; note = Arthrobacter sp.
gatgaggtgggagaaacacgtggtgtctatccctctccggggttaccccggggcacgcaatattgcctggaccatgcaccgcaggtgcggctctgcgctccgcgcagcacggcacccgcacagatagttaagtcatccg

SEQ ID NO: 18177 - RNA, 139 nt, unidentified
  source 1..139: mol_type = other RNA; note = Related to CP012677.1; note = Arthrobacter alpinus
gatgaggcgggagaaacactttgtgttcatccctctccggggttaccccggggtacgcagtattgcctggaccatgcaccgctggtgcctcactgcgctgcgcgcagccgggcaccagcacagacagccaagtcatccg

SEQ ID NO: 18178 - RNA, 136 nt, unidentified
  source 1..136: mol_type = other RNA; note = Acidobacteria bacterium; note = Related to JABBNV010000050.1
ggcgaggctggattgcaactagttgcagtcctctccggggctaccccggggtacaaggcacggatggccattgcaccgcgggtggggcactgcgcttcgcgcagctcgccacccgcacagactgacaggtcgccgg

SEQ ID NO: 18179 - RNA, 139 nt, unidentified
  source 1..139: mol_type = other RNA; note = Related to NZ_JADNYM010000009.1; note = Arthrobacter sp.
gatgaggcgggtggtgtacttcgtataccgtcctctccggggctaccctggggcacgcagaattacctgaagcaagcgccgcaggcgccagactgcgctccgcgcagctgcgcgcccgcacagatagacgggtcatcca

SEQ ID NO: 18180 - RNA, 140 nt, unidentified
  source 1..140: mol_type = other RNA; note = Related to NZ_JAATJL010000001.1; note = Arthrobacter pigmenti
gacgaggcggatggtgcacgcgatgttccatcctctccggggctaccccgggggacgcagatagacctcacacagagcgcctcaggtgcgacgctgcgcttcgcgcagtcaggcacccgaacggacaggcaggtcgtccg

SEQ ID NO: 18181 - RNA, 139 nt, unidentified
  source 1..139: mol_type = other RNA; note = Related to NZ_JAAOYV010000002.1; note = Frigoribacterium endophyticum
ggcgaggcgggtgctccacgcgctggatcaccctctccggggcaaccccggggcacgcagttcgaccacggcaccgctccccgagccgaccaccgcgctgcgcgcggagaccggcccggaccgacgcacgagtcgccgg

SEQ ID NO: 18182 - RNA, 139 nt, unidentified
  source 1..139: mol_type = other RNA; note = Related to RKIE01000002.1; note = Frigoribacterium sp.
gacgaggcgggcggcctccgcgtgaggtcgtcctctccggggcaaccccggggcacgcagtcagaccacggcaccgctccccgagccggtcaccgcgctccgcgcggcgggcggcacggaccgacgcacgagtcgtcac

SEQ ID NO: 18183 - RNA, 139 nt, unidentified
  source 1..139: mol_type = other RNA; note = Related to NZ_LMQR01000001.1; note = Frigoribacterium sp.
ggcgaggtggacggcacacgcgctgtgccttcctctccggggctaccccggggcacgcagatcgaccacggcaccgcaccgcaggccggtgaccgcgcttcgcgcggctcgcggcccgcaccgacgcacgagtcgccga

SEQ ID NO: 18184 - RNA, 139 nt, unidentified
  source 1..139: mol_type = other RNA; note = Related to NZ_CP014619.1; note = Frondihabitans sp.
gacgaggcggacggcgcaggctctgcgccgtcctctccggggctaccccggggcacggagaacgaccaggaacacgcaccgcaggagccagaccgcgcggagcgcggtccagcacccgcaccgatggacgagtcgtccg

SEQ ID NO: 18185 - RNA, 138 nt, unidentified
  source 1..138: mol_type = other RNA; note = Related to NZ_PVTL01000004.1; note = Glaciihabitans tibetensis
gttgaggtgggtggttcacgagttgtgccaccctctccggggataccccggggtacgcagaacaccagaaacacgcgccgcaggcgcctgagtgcgcttcgcgcaccacagcgcccgcacagacggacgagtcgaccg

SEQ ID NO: 18186 - RNA, 139 nt, unidentified
  source 1..139: mol_type = other RNA; note = Related to JADKRN010000004.1; note = Agreia pratensis
gacgaggtgggtggagtcgacagacggacaccctctccggggtcaccccggggtatgaatctcagcccgagcgcacaaccgcaggcactccaccgcgcttcgcgcggccgcgtgcccgcaacgatcgattggtcgtccg

SEQ ID NO: 18187 - RNA, 139 nt, unidentified
  source 1..139: mol_type = other RNA; note = Related to NZ_FXAY01000002.1; note = Agreia pratensis
gacgaggtgggtggagtcgacagacggacaccctctccggggtcaccccggggtatgaatctcagcccgagcgcacaaccgcaggcactccaccgcgcttcgcgcggccgcgtgcccgcaccgatcgattggtcgtccg

SEQ ID NO: 18188 - RNA, 139 nt, unidentified
  source 1..139: mol_type = other RNA; note = Related to FUYG01000003.1; note = Agreia bicolorata
gacgaggcgggtggagtcgacagacgaacaccctctccggggtcaccccggggtacaactctcagcctgaacgcacaaccgcaggcaccacaccgcgcttcgcgcggtcgcgtgcccgcaccgatcgatcggtcgcccg

SEQ ID NO: 18189 - RNA, 139 nt, unidentified
  source 1..139: mol_type = other RNA; note = Related to LMNF01000001.1; note = Agreia sp.
ggcgaggtgaacggcgtcgcgagacgatcgttctctccggggccaccccggggcacacatcccagccagaacgcacaaccgcaggcaccgcaccgcgcttcgcgcggccgggtgcccgcaccgatcgatcggtcgcccg

SEQ ID NO: 18190 - RNA, 139 nt, unidentified
  source 1..139: mol_type = other RNA; note = Related to NZ_LR882035.1; note = Agreia sp.
agcgaggtgggtggcgtctcgcgatgctcaccctctccggggctaccccggggcacttctcctagcctccacacggaaccgcaggcactacaccgcgcttcgcgcggccatgtgcccgcaccgatcgactggtcgctcg

SEQ ID NO: 18191 - RNA, 139 nt, unidentified
  source 1..139: mol_type = other RNA; note = Related to NZ_KI914784.1; note = Arthrobacter sp.
gccgaggcggagagtgcacgaggtgcgccctcctctccggggttaccccggggtacgcagatcgaccaggacaaagcgccgcaggcacgtgacagcgctccgcgcagcacagagcccgcacggacggacaggtcggccg

SEQ ID NO: 18192 - RNA, 138 nt, unidentified
  source 1..138: mol_type = other RNA; note = Related to CP047186.1; note = Rathayibacter sp.
ggcgaggcggacggggcacgcgctgctccgtcctctccggggtcaccccggggcacgtggatcaaccaggcatcgcgccgcaggcacccgcccgcgctgcgcgcggctcagcgcccgcacttctcgacaggtcgcccg

SEQ ID NO: 18193 - RNA, 138 nt, unidentified
  source 1..138: mol_type = other RNA; note = Related to NZ_CP047180.1; note = Rathayibacter festucae
ggcgaggcggacggggcacgcgctgctccgtcctctccggggtcaccccggggcacgtggatcgaccaggcatcacgccgcaggcacccacccgcgctccgcgcggcacagcgcccgcacagctcgacaggtcgcccg

SEQ ID NO: 18194 - RNA, 138 nt, unidentified
  source 1..138: mol_type = other RNA; note = Related to NZ_FXBM01000004.1; note = Rathayibacter oskolensis
ggcgaggcggacggggcacgagctgcaccgtcctctccggggtcaccccggggcacgtggatcgaccaggcatcacgccgcaggcacccgccggcgctccgcgccgctcagcgccagcacttctcgacaggtcgcccg

SEQ ID NO: 18195 - RNA, 138 nt, unidentified
  source 1..138: mol_type = other RNA; note = Related to NZ_PZPL01000001.1; note = Rathayibacter caricis
ggcgaggcggacgatgcacgagctgcaccgtcctctccggggtcaccccggggcacgtggatcgaccaggcaccgcaccgcaggcacccgcccgcgctccgcgcggctcagcgcccgcacttcccgacaggtcgcccg

SEQ ID NO: 18196 - RNA, 139 nt, unidentified
  source 1..139: mol_type = other RNA; note = Related to NZ_LMMJ01000014.1; note = Curtobacterium sp.
accgaggcggccggcgcacgctgtgcgtcgacctctccggggctcccccggggcacgaagtacacccatgaccgtccacctcaggagaagaggcgcgctccgcgcaccgtccctcccgaaccacacgacgagtcggtcg

SEQ ID NO: 18197 - RNA, 139 nt, unidentified
  source 1..139: mol_type = other RNA; note = Related to LMPO01000009.1; note = Curtobacterium sp.
ggggaggcggacggcgcgcgagacgcgccgacctctccggggtcaccccggggcacgcaggaccagcaggaccacacgccccgagaggctcggcgcgctccgcgcgctcgccctcacggaggcaccgacaggtcccccg

SEQ ID NO: 18198 - RNA, 139 nt, unidentified
  source 1..139: mol_type = other RNA; note = Related to JALGRO010000013.1; note = Curtobacterium sp.
ggggaggcggacggcgcgcgtgacgcgtcgacctctccggggtcaccccggggcacgcagtaccagcaggacgacacgccccgagaggctcggcgcgctccgcgcgcgctccctcacggaggcaccgacaggtcccccg

SEQ ID NO: 18199 - RNA, 139 nt, unidentified
  source 1..139: mol_type = other RNA; note = Related to MJGI01000025.1; note = Curtobacterium sp.
ggggaggcggacggcgcgcgtgacgcgccgacctctccggggtcaccccggggcacgcagtaccagcaggaccacacgccccgagaggcacggcgcgctccgcgcactcgccctcacggaagcactgacaggtctcccg

SEQ ID NO: 18200 - RNA, 139 nt, unidentified
  source 1..139: mol_type = other RNA; note = Related to MJGP01000013.1; note = Curtobacterium sp.
ggggaggcggacggcgcgcgtgacgcgtcgacctctccggggtcaccccggggcacgcaggaccagcaggaccacacgccccgagaggcgcggcgcgctccgcgcaccagccctcacggaggcaccgacaggtcccccg

SEQ ID NO: 18201 - RNA, 139 nt, unidentified
  source 1..139: mol_type = other RNA; note = Related to JACGXP010000002.1; note = Curtobacterium pusillum
ggggaggcggccggcgcgcgtgacgcgccgacctccccggggtcaccccggggcacgcggtaccagcaggacgacacgccccgagcgggcaggcgcgctccgcgcgcgacgccgcacggaggcaccgacgggtcctccg

SEQ ID NO: 18202 - RNA, 139 nt, unidentified
  source 1..139: mol_type = other RNA; note = Related to JAFBBT010000001.1; note = Curtobacterium herbarum
ggggaggcggacggcgcgcgtgacgcgtcgacctctccggggtcaccccggggcacgcaggaccagcaggaccacacgccccgagaggctcggcgcgctccgcgcgcgcgtcctcacggaggcaccgacaggtcccccg

SEQ ID NO: 18203 - RNA, 139 nt, unidentified
  source 1..139: mol_type = other RNA; note = Related to QKLJ01000002.1; note = Curtobacterium sp.
ggggaggcggacggcgcgcgtgacgcgtcgacctctccggggtcaccccggggtacgcaggaccagcagcaccacacgccccgagaggctcggcgcgctccgcgcgcgcgacctcacggaggcaccgacaggtctcccg

SEQ ID NO: 18204 - RNA, 139 nt, unidentified
  source 1..139: mol_type = other RNA; note = Related to NZ_CP017580.1; note = Curtobacterium sp.
ggggaggcggccgacgcgcgtgacgcgtcgacctctccggggtcaccccggggcacgcaggaccagcaggacgacacgccccgagcgggacggcgcgctccgcgcgcgacgccgcacggaggcaccgacgggtcccccg

SEQ ID NO: 18205 - RNA, 139 nt, unidentified
  source 1..139: mol_type = other RNA; note = Related to NZ_CP081964.1; note = Curtobacterium sp.
ggggaggcggccggcgcgcgtgacgcgtcgacctctccgggggcaccccggggcacgcaggaccagcaggacgacacgccccgagcaggcgagcgcgctccgcgcgcgacgctgcacggaggcaccgacaggtcctccg

SEQ ID NO: 18206 - RNA, 139 nt, unidentified
  source 1..139: mol_type = other RNA; note = Related to NZ_CP027869.1; note = Curtobacterium sp.
ggggaggcggccgacgcgcgcgacgcgtcgacctctccggggtcaccccgggacacgcaggaccagcacgacgacacgccccgagcgggagagcgcgctccgcgcgccacgccgcacggaggcaccgacgggtcccccg

SEQ ID NO: 18207 - RNA, 139 nt, unidentified
  source 1..139: mol_type = other RNA; note = Related to NZ_CP076544.1; note = Curtobacterium sp.
ggggaggcggacggcgcgcgcgacgcgtcgccctccccggggtcaccccggggcacgcaggaccagcaggaccacacgccccgagaggctcggcgcgctccgcgcgcgctccctcacggaggcaccgacaggtcccccg

SEQ ID NO: 18208 - RNA, 139 nt, unidentified
  source 1..139: mol_type = other RNA; note = Related to NZ_CP093378.1; note = Curtobacterium luteum
ggggaggcggatgacgcacgcggtgcgtcgtcctctccggggtcaccccggggtacgcaggaccagcaggacaccacgccccgagcgggcaggcgcgctccgcgcgcgacgccgcacggaggcaccgacgggtcccccg

SEQ ID NO: 18209 - RNA, 139 nt, unidentified
  source 1..139: mol_type = other RNA; note = Related to JAGGPH010000002.1; note = Curtobacterium sp.
ggggaggcggacggcgtacgtggtgcgtcgtcctctccggggcaaccccggggaacgcaggaacagctgacacacccgccccgagaggctcggcgcgctccgcgcgcgctccctcacggcagcaccgatcagtcccccg

SEQ ID NO: 18210 - RNA, 139 nt, unidentified
  source 1..139: mol_type = other RNA; note = Related to NZ_CP014513.1; note = Frondihabitans sp.
ggggaggcggacgacgctcgacgagcgccgtcctctccggggtcaccccgggggacgcagaacgaccagcagcacacgccccgagaggctcggcgcgcttcgcgcgctcgacctcacggacgcatcgacgggtcccccc

SEQ ID NO: 18211 - RNA, 139 nt, unidentified
  source 1..139: mol_type = other RNA; note = Related to QKTP01000001.1; note = Curtobacterium sp.
ggcgaggcggatggagcacgcgctgctgcatcctctccggggctcccccggggcacgcggatcgaccaggaacacacgcctcaggagctcgggcgcgctccgcgcgctgacgctcccgaacggcacgacgagtcgtccg

SEQ ID NO: 18212 - RNA, 139 nt, unidentified
  source 1..139: mol_type = other RNA; note = Related to NZ_LMNV01000002.1; note = Frondihabitans sp.
ggcgaggcgggcggcacacgagctgtgccgccctctccggggctaccccgggggacgaagatcgacgagaacacgacaccgcgagaggccgagcgcgcttcgcgcgccctgcctcccgcaccggcggatgagtcgttcg

SEQ ID NO: 18213 - RNA, 139 nt, unidentified
  source 1..139: mol_type = other RNA; note = Related to RJUO01000002.1; note = Frondihabitans sp.
gacgaggcggaccgcgttcgatgagcgcggttctctccggggctaccccgggggacgaggattgaccacgacatgacaccgcgagaggcgaagcgcgcttcgcgcaccctgcctcccgcaccggccgatgagtcgtccg

SEQ ID NO: 18214 - RNA, 139 nt, unidentified
  source 1..139: mol_type = other RNA; note = Related to NZ_UEXK01000004.1; note = Klenkia terrae
ctcgaggacgccgtgccgcaggtcgggccggcagctccggggatgccccggggaccgcacgcagcctccaccaccacgcctccggcgcgacgcagcgctccgcgcagctcagcgtcgggacgacgggaccggtcgaccc

SEQ ID NO: 18215 - RNA, 139 nt, unidentified
  source 1..139: mol_type = other RNA; note = Related to NZ_FMUH01000007.1; note = Klenkia marina
gtcgagggtgccgctccgcaggtcggcgcggcagctccggggatgccccggggaccgcacgcagcctccaccaccacgcctccggcgtgtcggtgcgctccgcgcacgcgtacgccgggacgacgggtcaggtcgaccc

SEQ ID NO: 18216 - RNA, 139 nt, unidentified
  source 1..139: mol_type = other RNA; note = Related to NZ_FNIR01000011.1; note = Klenkia soli
accgaggatgccgtgccgcgcgtcggtccggcagctccggggatgccccggggacagcacgcagcctccaccaccacgcctccggcgctcggcagcgctccgcgcagctccgcgtcgggacgacgggacaggtcggccc

SEQ ID NO: 18217 - RNA, 139 nt, unidentified
  source 1..139: mol_type = other RNA; note = Related to LMQC01000019.1; note = Modestobacter sp.
gtcgaggacgccgcaccgctggtcggtccggcagctccggggatgccccggggaccgcacgacgcctccaccacgacgcctccggcgccgcgctgcgctccgcgcagcagagcgccggtccgacgggacaggtcgaccc

SEQ ID NO: 18218 - RNA, 139 nt, unidentified
  source 1..139: mol_type = other RNA; note = Related to CP043652.1; note = Geodermatophilaceae bacterium NBWT11
gccgagggtgccggaccgcaggtcggaccggcagctccgggggtgccccggggaccgcagcacgccgccaccaccacgcctccggccacgcgctgcgctccgcgcagccgatggtcgggacgacgggacaggtcggccc

SEQ ID NO: 18219 - RNA, 139 nt, unidentified
  source 1..139: mol_type = other RNA; note = Related to NZ_JAABOZ010000008.1; note = Modestobacter sp.
gtcgaggtcgccggaccgctctgcggaccggcagctccggggcagccccgggcacggcagggagcctccaccaccacgacgcaggcgtgtcgctgcgctccgcgcaggtcaacgcccgcacgacgggactggccgaacc

SEQ ID NO: 18220 - RNA, 141 nt, unidentified
  source 1..141: mol_type = other RNA; note = Related to JACCXW010000487.1; note = Geodermatophilaceae bacterium
ggcgagaaacgcccggccgcttcggcggactggcagctccggggctaccccgggggccgcgtcacgacctcaccacggcaccgcaggcgcgccgctgcacggcaagcagctatgcgcccgcacgaccagacaggtcgcccg

SEQ ID NO: 18221 - RNA, 141 nt, unidentified
  source 1..141: mol_type = other RNA; note = Related to JACDAB010000197.1; note = Geodermatophilaceae bacterium
ggcgagaaacgcccggccgcttcggcggactggcagctccggggctaccccgggggccgcgtcacgacctcaccacggcaccgcaggcgcgccgctgcacgccaagcagctatgcgcccgcacgaccagacaggtcgcccg

SEQ ID NO: 18222 - RNA, 139 nt, unidentified
  source 1..139: mol_type = other RNA; note = Related to JABEMA010000014.1; note = Pseudokineococcus marinus
ggcgaggtcgccgacccgcgagccgggacggcgggtccggggctaccccgggcgctgcaggaggagatcgacaccccgccgcaggcaccgcgccgcgctccgcgcggccgggtgcccgcacgacgggacaggtcgtcgg

SEQ ID NO: 18223 - RNA, 138 nt, unidentified
  source 1..138: mol_type = other RNA; note = Related to NZ_QCXS01000003.1; note = Nakamurella deserti
ggcgagaacgccggccggcgacggcccggccgctccggggtacccccggggccggaacaccgcagcaagcacgaccgtgcaggcacgtcgtggcgctccgcgccaggttgtgcccgcccagcagggacaggtcgacca

SEQ ID NO: 18224 - RNA, 138 nt, unidentified
  source 1..138: mol_type = other RNA; note = Related to QXCQ01000133.1; note = Nakamurella silvestris
gacgagaacgccggtcggcaacgacccggcctctccggggtacccccggggtgcgatcaccgcagttggcaccaccatgcaggcagggcggtgcgctccgcgcacacacctgcccgcccagcagggacaggtcgtcca

SEQ ID NO: 18225 - RNA, 138 nt, unidentified
  source 1..138: mol_type = other RNA; note = Related to NC_013235.1; note = Nakamurella multipartita
ggcgagaactccggccggtgacggttcggacgctccggggcacccccggggtgggttcaccgcagttggcaccaccgagcaggcacatcgacgcgctccgcgcatgcaggtgcccgcccagcagggacaggtcgccca

SEQ ID NO: 18226 - RNA, 152 nt, unidentified
  source 1..152: mol_type = other RNA; note = Related to SZZH01000005.1; note = Nakamurella flava
gacgagaactccgatcgggaacggctcgtccgtccctgtcccggacgctccggggtacccccggggtgagcatgtcgcaccaggcacgaccgagcaggcccggcgctgcgctccgcgaaggagcgggcccgcccagcagcacaggtcgtcgt

SEQ ID NO: 18227 - RNA, 124 nt, unidentified
  source 1..124: mol_type = other RNA; note = Related to NZ_JAERWK010000005.1; note = Nakamurella leprariae
gccgggccgatgccggagcctccggggcaaccccggggccagcaggtcgagcaccgcagcgcaccgcaggccggacgacaggctccacctctgtcgcggcccgcacaggcgagcaggtcgtcgt

SEQ ID NO: 18228 - RNA, 150 nt, unidentified
  source 1..150: mol_type = other RNA; note = Related to NZ_JAERWL010000005.1; note = Nakamurella flavida
cacgagaacgtccgagtccccgggtccgcccggggccgggactctccggggtacccccggggtcgagcaggtcagctccaccagcacgccgcaggcaggcgcatggcgctccgcgccaggacctgcccgcacagcgacaccggtcgtgcg

SEQ ID NO: 18229 - RNA, 141 nt, unidentified
  source 1..141: mol_type = other RNA; note = Related to NZ_LT629799.1; note = Microlunatus sagamiharensis
ggcgagatcacgagcccgctccggcgggatcggtgcccgaggctccctcgggtagtagcaggtccacctcgcagcaggtccgcaggtgcgagaccgcgctccgcgcggctcggcacccgctcgtgcaggactggtcgtccg

SEQ ID NO: 18230 - RNA, 141 nt, unidentified
  source 1..141: mol_type = other RNA; note = Related to JACHZG010000001.1; note = Microlunatus antarcticus
ggcgagaacgcgaccccgctccggcgggatcggtgcccgaggctccctcgggtggcagcaggtcaaccccgcagcaggtcggcaggtgcgcgactgcgctccgcgcaggtcggcacccgctcgtgcaggactggtcgtccg

SEQ ID NO: 18231 - RNA, 139 nt, unidentified
  source 1..139: mol_type = other RNA; note = Related to AP012204.1; note = Microlunatus phosphovorus
cgcgagaatccgagccgcttcggcggatcggcgcccgaggctccctccggtgacagcacgttcaccctgccgcaggtccgcaggtgccccgctgcgcttcgcgcaggaacgcacccgctcaggcaagacaggtcgcccg

SEQ ID NO: 18232 - RNA, 155 nt, unidentified
  source 1..155: mol_type = other RNA; note = Related to NZ_LT629772.1; note = Microlunatus soli
agcgaggttccaccgcacagtgcgacaatcaacgatctgtcgtcgtgcggcgcccgaggaaccctcgggtgatggtgatcattccggccgacgatcgcaggcaacgcagcgggctccgcccgcctctttgcccgcagcacaggacaggtcgcagt

SEQ ID NO: 18233 - RNA, 139 nt, unidentified
  source 1..139: mol_type = other RNA; note = Related to NZ_BMMZ01000006.1; note = Microlunatus endophyticus
agcgaagattcaccgggcatcaacgatgtctggcgcccgaggcaccctcgggtgggagtgatccacggtgcagcacgatcgcaggccacgcggcgggctccgcccgcgtgctggcccgcacgacgcgacaggtcgcacg

SEQ ID NO: 18234 - RNA, 139 nt, unidentified
  source 1..139: mol_type = other RNA; note = Related to JADJPO010000003.1; note = Kineosporiaceae bacterium
gacgagatggccgacgcggcaacgcgtccggcgtcttcggggctaccccgaggtgggcacgacaaccagggcatcacggcgcaggtgccggacagcgctgcgcgctgttccgcacccgcaggacgagttcggtcggacg

SEQ ID NO: 18235 - RNA, 140 nt, unidentified
  source 1..140: mol_type = other RNA; note = Related to JAHBAY010000005.1; note = Kineosporia corallincola
ggcgagaactccggctggcctcgtccggacggtcgctccggggctaccccggggaaaccggcacgtcctcggcatcacgccgcacgtgccacgcagcgctccgcgctgctacgcacgcgcactgcacgacaggtcgcacc

SEQ ID NO: 18236 - RNA, 140 nt, unidentified
  source 1..140: mol_type = other RNA; note = Related to NZ_JAJOMB010000003.1; note = Kineosporia babensis
gacgagaacgccgtccggccggttccgggcggttgatccggggttaccccgggcacggcaccatatccacggcaccacgccgcacgtgcaccgcagcgctccgcgcagctcggcacgcgcacaaccggtcaggtcgttgc

SEQ ID NO: 18237 - RNA, 137 nt, unidentified
  source 1..137: mol_type = other RNA; note = Related to JAANNO010000010.1; note = Motilibacter aurantiacus
ggcgagaccgccggagcgcttcgcgccggccgctgcggggctcccccgtggcacggttcctctgttgggcaccacgtcgcatgcacgtctccacgctgcgcggaggcgagtgcacgcacggcgagacaggtcgccgc

SEQ ID NO: 18238 - RNA, 154 nt, unidentified
  source 1..154: mol_type = other RNA; note = Related to NZ_LT629710.1; note = Nakamurella panacisegetis
ggcgagactgctggttcgcctccgagtggtcagcggggccgatcagctgctccggggataccccggggccggttgtggtggtatcgcagcacgtcacaggcatgatgccgcgctccgcgcagggcaatgcccgtcaggcaggacaggtcgcctg

SEQ ID NO: 18239 - RNA, 159 nt, unidentified
  source 1..159: mol_type = other RNA; note = Related to NZ_CP060298.1; note = Nakamurella sp.
ggcgagactgctggttcgcctccgcgcagggatcggcggaggtcgaccggctgctccggggttaccccggggtaggtatcggtggtaccgcatcacgtcgcaggcacgcggttgcgctccgcgcaacgccgtgcccgccaggcggggacaggtcgcccg

SEQ ID NO: 18240 - RNA, 140 nt, unidentified
  source 1..140: mol_type = other RNA; note = Related to JAAALN010000029.1; note = Kineococcus siccus
ggcgagagggtcaggccggtgcgccggcccgaccggtccggggtcaccccgggcgcagcacgacgaccacggcgcggcgccgcaggaacccgcctgcgctccgcgcagctcagtacccgcacgacgggacgggtcgcccg

SEQ ID NO: 18241 - RNA, 140 nt, unidentified
  source 1..140: mol_type = other RNA; note = Related to JALDAT010000072.1; note = Paenibacillus sp.
ggcgagagggccgagccggtacgccggtgacgccgctccggggttcccccggggacagcacgacgaccacggcagggcgccgcagggacgtcgctgcgctgcgcgcaggacggtccccgcacgacgggacgggtcgcccg

SEQ ID NO: 18242 - RNA, 152 nt, unidentified
  source 1..152: mol_type = other RNA; note = Related to JACCBB010000001.1; note = Kineococcus aurantiacus
tgcgagagggccctcccggcgccggtgcaccggcggtggggcggcagctccggggtcaccccgggggcagcacgacacgttcggcaccacgccgcaggatcgaccgtgcgctgcgcgcactgcggatcccgcaccgcgggacaggtcgcccg

SEQ ID NO: 18243 - RNA, 148 nt, unidentified
  source 1..148: mol_type = other RNA; note = Related to JAFAOY010000834.1; note = Solirubrobacterales bacterium
accgaggtgggtgttggcgccttcgggcgctgagccctctccgggggtaccccggggacacctttgtgaccaggccagcgcatcgcgagccctcgcctgcgtccgtcggaagcagctcagggcacgcacgacgaagtgcagtcggcgc

SEQ ID NO: 18244 - RNA, 152 nt, unidentified
  source 1..152: mol_type = other RNA; note = Related to JAFARL010000184.1; note = Solirubrobacterales bacterium
accgaggtgggtcgacgcgcccctgtgggcgctgaaactctctccggggctaccccggggacaccggtgtgaccaggccagcgcatcgcgagccctcccctgcgtccggttggaagcagttctgggcacgcacgacgaagtgcagtcggcgc

SEQ ID NO: 18245 - RNA, 150 nt, unidentified
  source 1..150: mol_type = other RNA; note = Related to JACCUP010000282.1; note = Thermoleophilaceae bacterium
gccgaggcggaacggacgcgccttcgggtgcgtcctcctctccggggccaccccggggataccgaagtgagcagggcagcgcaccgcgggcccgctactgctcccatcacggggcaggtcggggcacgcacgacgtggagcggtcggcac

SEQ ID NO: 18246 - RNA, 150 nt, unidentified
  source 1..150: mol_type = other RNA; note = Solirubrobacterales bacterium; note = Related to JACCUX010000400.1
accgaggcgggtggacgcgccttcgggtgcgtctccctctccggggctaccccggggaaagcaggtctgaccgaagcagagcatcgcgagcccttcgctgcacccacaagggggcaggcgcgggcgcgcacggcacagagcggtcggcgg

SEQ ID NO: 18247 - RNA, 145 nt, unidentified
  source 1..145: mol_type = other RNA; note = Related to NZ_KI912613.1; note = Patulibacter minatonensis
cccgagacggcaccgcggatccctcgggatcacgggccgctccggggaacccccgggggcaccggtgatggccggacatcgcatcgcgtgcgctcgaccgccgctccgcgcgggggcgcgcacgcacgacgcaggaggtcgggcc

SEQ ID NO: 18248 - RNA, 142 nt, unidentified
  source 1..142: mol_type = other RNA; note = Related to NZ_AUKG01000002.1; note = Conexibacter woesei
cccgagccggtgcgcccgccctcgggcgggccacctctccggggtcaccccggggatcagcaggaaccacggcacggcagcgcgtgcgggctgcggcgacgagccgccatgccccgcacgcacgacacgggaccgtcgggcc

SEQ ID NO: 18249 - RNA, 146 nt, unidentified
  source 1..146: mol_type = other RNA; note = Solirubrobacteraceae bacterium; note = Related to JAEMSV010000041.1
cccgagccggtactgcgcatccccgtggtgcgcagcgccctccggggctcccccggggacgacctccacacctcagcaccacatcacgtgcgacctgccgctgcttcgccgcgggtctacgcacgtacgacgggagacgtcgggcc

SEQ ID NO: 18250 - RNA, 163 nt, unidentified
  source 1..163: mol_type = other RNA; note = Related to NZ_RBIL01000001.1; note = Solirubrobacter pauli
cccgagcccgcaccggacatgaagggtcagaccccttgtgttcgcgaggtgcgtctccggggttcccccggggagatcgaggtaccagaggcagtgcatcgcgtgtgcgcgggtgcgcccgtccggggcacgtctgcacacgcacgacaggagccgtcgggtg

SEQ ID NO: 18251 - RNA, 147 nt, unidentified
  source 1..147: mol_type = other RNA; note = Pseudonocardiales bacterium; note = Related to QHCD01000081.1
gtcgagagggtcgatgcgcgattccggtcgcccgtcgatcgctccggggaaaccccggggacgaacaagatccctcgcctccacatcacatgcgccgacgtgcgccacaacgcacccgcgcgcacgcacgatgagacaggtcgactc

SEQ ID NO: 18252 - RNA, 146 nt, unidentified
  source 1..146: mol_type = other RNA; note = Acidimicrobiales bacterium; note = Related to CADCTB010000222.1
cgcgagacctgtccggaccgccttcgggcgggaccggatcgctccggggttaccccggggtcatcgccttacctgggcatctcgtcgcatgcgcccgcgtccgctccacggacggcagcgcacacaccactgggactcgtcgcgtt

SEQ ID NO: 18253 - RNA, 135 nt, unidentified
  source 1..135: mol_type = other RNA; note = Solirubrobacterales bacterium; note = Related to JAFMRN010000002.1
tttgagttgggtcagcggaccctctctgggggttccccagggatcaccattcagtagggcaatgcgtcgcgcgtcctactttgtcgtgccccttcgtggcacctcgggacggcgcaggacaggagcagtcaagcc

SEQ ID NO: 18254 - RNA, 146 nt, unidentified
  source 1..146: mol_type = other RNA; note = Related to NZ_PPDK01000002.1; note = Euzebya tangerina
accgagatcggttgccggcccctcgcgggtctggtcaccaccttcggggaacccccgaggacacacgcgtcatctgacgctccatcgcatgcaggtgctgcacgcgttgcgtgcgagtctgcacacaccacgaagctggtcgggac

SEQ ID NO: 18255 - RNA, 144 nt, unidentified
  source 1..144: mol_type = other RNA; note = Related to NZ_JACXYY010000008.1; note = Nocardioides hwasunensis
ttcgagacggcggaccggtgcgtgtcaccggtcagcttccccggggctaccccggggaccaccggaatgttcgggcacggcaccgcgcgcgacaggctgcgctccgctgcaggtcgccgcgcgcacgacgggacaggtcgagct

SEQ ID NO: 18256 - RNA, 144 nt, unidentified
  source 1..144: mol_type = other RNA; note = Related to NZ_FNRT01000002.1; note = Nocardioides exalbidus
ttcgagacggctcaccggtgcgcgtcaccggtcagcttctccggggctaccccggggaccaccggaacgttcgggcactgcaccgcgcgcgacgcgctgtgcttcgctgcaggaggtcgcgcgcacgacgggacaggtcgggct

SEQ ID NO: 18257 - RNA, 144 nt, unidentified
  source 1..144: mol_type = other RNA; note = Related to NZ_JACJGN010000045.1; note = Nocardioides lijunqiniae
ctcgagacggcgaaccggtgcgtgacaccggcaagcctccccggggctaccccgggggccaccgacatgttcgggcacggcaccgcgcgcgcatcgctgcgctccgctgcaggtccgcgcgcgcacgacgggacaggtcgagca

SEQ ID NO: 18258 - RNA, 144 nt, unidentified
  source 1..144: mol_type = other RNA; note = Related to NZ_CP053660.1; note = Nocardioides sp.
ctcgagacggcgaaccggtgcatgacaccggtctgcctccccggggataccccgggggccaccggcatgttcgggcacagcaccgcgcgcgactcgctgcgcttcgctgcaggtcttcgcgcgcacgacgggactggtcgagca

SEQ ID NO: 18259 - RNA, 144 nt, unidentified
  source 1..144: mol_type = other RNA; note = Related to NZ_JAFBCA010000001.1; note = Nocardioides cavernae
ctcgagacggcggaccggtgcgcgtcaccggtcggcttctccggggctaccccggggaccaccggatcgttcgggcacggcaccgcgcgcgactcgctgcgctccgctgcaggtcatcgcgcgcacgacgggacaggtcgggct

SEQ ID NO: 18260 - RNA, 144 nt, unidentified
  source 1..144: mol_type = other RNA; note = Related to NZ_CP022296.1; note = Nocardioides sp.
ctcgagacggcggaccggtgcgcgtcaccggtttgcttctccggggctaccccggggaccaccggtacgtccgggctcagcaccgcgcgcgactcgctgcgctccgctgcaggtcatcgcgcgcacgacgggacaggtcgggcc

SEQ ID NO: 18261 - RNA, 144 nt, unidentified
  source 1..144: mol_type = other RNA; note = Related to JABJQY010000002.1; note = Nocardioides sp.
ctcgagacggcggaccggtgcgcgtcaccggtcggcctccccggggataccccggggaccaccggtacgtccgggcacggcaccgcgcgcggctcgctgcgctccgctgcaggccaccgcgcgcacgacgggacaggtcgagca

SEQ ID NO: 18262 - RNA, 144 nt, unidentified
  source 1..144: mol_type = other RNA; note = Related to NZ_CP087710.1; note = Nocardioides sp.
ctcgagacggcggaccggtgcgcgtcatcggtcggcctccccggggctaccccggggaccaccggtacgtccgggctcagcaccgcgcgcgacgcgctgcgcttcgctgcaggagatcgcgcgcacgacgggacaggtcgaggc

SEQ ID NO: 18263 - RNA, 144 nt, unidentified
  source 1..144: mol_type = other RNA; note = Related to JAKJHZ010000001.1; note = Nocardioides sp.
ctcgagacggcggaccggtgcgcgtcaccggcccacctctccggggataccccgggggccaccggaacgttcgggcacggcaccgcgcgcgaagcgctgcgctccgctgcaggagatcgcgcgcacgacgggacaggtcgagca

SEQ ID NO: 18264 - RNA, 144 nt, unidentified
  source 1..144: mol_type = other RNA; note = Related to FOKC01000001.1; note = Nocardioides alpinus
ctcgagacggtgaaccggtgcgcgtcaccggttcgcttctccggggctaccccggggaccaccggaacgttcgggcactgcaccgcgcgcgactcgctgcgctccgctgcaggtcatcgcgcgcacgacgggacaggtcgagct

SEQ ID NO: 18265 - RNA, 144 nt, unidentified
  source 1..144: mol_type = other RNA; note = Related to NZ_JZDQ02000022.1; note = Nocardioides luteus
ctcgagacggcgagccggtgcgtgacaccggtcagcctccccggggctaccccgggggccaccggtacatccgggcacggcaccgcgcgcgacaggctgcgctccgctgcaggtcgccgcgcgcacgacgagacaggtcgagga

SEQ ID NO: 18266 - RNA, 144 nt, unidentified
  source 1..144: mol_type = other RNA; note = Related to FMZM01000021.1; note = Nocardioides lianchengensis
ctcgagacggccgaccggtgtgcgtcaccggccagcctccccggggctaccccggggaccaccggaacgttcgggcacggcaccgcgcgcgactcgctgcgctccgctgcaggtcttcgcgcgcacgacgggacaggtcgagca

SEQ ID NO: 18267 - RNA, 144 nt, unidentified
  source 1..144: mol_type = other RNA; note = Related to JAFBBZ010000001.1; note = Nocardioides salarius
ctcgagacggtgagctggcgcgcgacgtcggtccacctccccggggctaccccgggggccaccggtacgtccgggcaccgcaccgcgcgcgagacgctgcgctccgctgcaggtcctcgcgcgcacgacgggacaggtcgggca

SEQ ID NO: 18268 - RNA, 144 nt, unidentified
  source 1..144: mol_type = other RNA; note = Related to NZ_CP075371.1; note = Nocardioides aquaticus
cttgagacggtgagccggtgcgcgacaccggaccacctccccggggctaccccgggggtcaccggaacgttcgggcaccgcaccgcgcgcgagacgctgcgctccgctgcaggaagtcgcgcgcacgacgagacaggtcgagca

SEQ ID NO: 18269 - RNA, 144 nt, unidentified
  source 1..144: mol_type = other RNA; note = Related to NZ_JADCLL010000001.1; note = Nocardioides kribbensis
ctcgagacggtggaccggtgcgtgacaccggcccgcctccccggggctaccccggggaccaccggcacgtccgggcacggcaccgcgcgcgagtcgctgcgctccgctgcaggaccccgcgcgcacgacgggacaggtcgagcc

SEQ ID NO: 18270 - RNA, 144 nt, unidentified
  source 1..144: mol_type = other RNA; note = Related to NZ_VDMR01000001.1; note = Nocardioides litoris
ctcgagacggttggccgacgcgcgtcgtcggtccacctccccggggctaccccgggggccaccggcacgtccgggcacggcaccgcgcgcgacacgctgcgctccgcggcaggaagccgcgcgcacgacgggacaggtcgagcg

SEQ ID NO: 18271 - RNA, 144 nt, unidentified
  source 1..144: mol_type = other RNA; note = Related to JAAGXA010000003.1; note = Nocardioides zeae
ctcgagacggtcaaccggtgcgcgtcaccggtcgacctccccggggctaccccggggaccaccggcacgtccgggcactccaccgcgcgcggctcgctgcgctccgctgcaggtctccgcgcgcacgacgggacaggtcgaggg

SEQ ID NO: 18272 - RNA, 144 nt, unidentified
  source 1..144: mol_type = other RNA; note = Related to NZ_SZVU01000003.1; note = Nocardioides dongxiaopingii
ctcgagacggtgacctggcgcgagtcgccagttcacctccccggggctaccccgggggccaccggtacgtccgggcactgcaccgcgcgcgcctcgctgcgctccgctgcaggtccgcgcgcgcacgacgggacaggtcgagca

SEQ ID NO: 18273 - RNA, 144 nt, unidentified
  source 1..144: mol_type = other RNA; note = Related to NZ_PVUE01000003.1; note = Antricoccus suffuscus
ttcgagaatgtcgatcggcgtacgacgtcgaacgacgtccccggggctaccccggggtcaaccggcatggccgggcacctcaccacgcgcgaggcactgcgcttcgcggcagctagtcgcgcgcacgacaggaatggtcgagcg

SEQ ID NO: 18274 - RNA, 144 nt, unidentified
  source 1..144: mol_type = other RNA; note = Related to NZ_VCQV01000003.1; note = Leekyejoonella antrihumi
ttcgagacgggtgaccggcgcgcagcgtcggttcacctctccggggttaccccgggggttaccggtacgtccgggcactgcaccgcgcgcgagcggctgcgcttcgcggcaggaagtcgcgcgcacgacaggacaggtcgaaca

SEQ ID NO: 18275 - RNA, 145 nt, unidentified
  source 1..145: mol_type = other RNA; note = Related to NZ_KB905425.1; note = Sciscionella marina
ctcgagaacggtcggcaggggcgtgacctcgctcgaccactcaggggttccccctgggatcaccggcagggtccggcagcgcaccgcgcgcgagccaccgcggaacgccgcagacattcgcgcgcacgacgtggttggtcgagtc

SEQ ID NO: 18276 - RNA, 132 nt, unidentified
  source 1..132: mol_type = other RNA; note = Related to NZ_QGTX01000001.1; note = Geodermatophilus normandii
ggcaggacgaccggcagcgaccggtctcccggggcgaccccggggcagcaggtcatcgccaccatcggcaccacccgccggacggcgcgctccgcgcacgcaccggcgactcccacgcggagtggctgcccg

SEQ ID NO: 18277 - RNA, 132 nt, unidentified
  source 1..132: mol_type = other RNA; note = Related to NZ_JABGCI010000002.1; note = Blastococcus endophyticus
ggcaggacgaccggcgagtccggtccctccggggcaaccccggggcagcacgtgtcagccaggcgcagcgtcacccgccggacggcgcgctccgcgcacgtcccggcgcctccctcagggagtggctgcccg

SEQ ID NO: 18278 - RNA, 132 nt, unidentified
  source 1..132: mol_type = other RNA; note = Related to NZ_SPQN01000061.1; note = Geodermatophilus sp.
ggcaggacgatcggcgtcagccggtctccccggggcaaccccggggcaacgcagcgagtcgggcatcgcgtcacccgccagcaggcgcgctccgcgcacgccctggcgactccctcagggggcggctgcctc

SEQ ID NO: 18279 - RNA, 132 nt, unidentified
  source 1..132: mol_type = other RNA; note = Related to FRDM01000010.1; note = Geodermatophilus obscurus
gtcgggacgaccggcgtcagccggtctccccggggctaccccggggcagcgcagcgagcagggcacggcgtcagccgccaccaggagcgctccgcgcacgacctggcgactccctcagggagcggctgcctc

SEQ ID NO: 18280 - RNA, 132 nt, unidentified
  source 1..132: mol_type = other RNA; note = Related to NZ_VFQE01000001.1; note = Blastococcus colisei
ggcaggacgaccggtgaggaccggttctcccggggaaaccccggggatcgcactgttcccgaacatctcgtcaaccgccaggccgtgcgctccgcgcacctgatggcgcctcgttcaggggccggctgcccg

SEQ ID NO: 18281 - RNA, 132 nt, unidentified
  source 1..132: mol_type = other RNA; note = Related to FOND01000013.1; note = Blastococcus sp.
ggcaggacgaccggtgaggaccggttctcccggggcaaccccggggatcgcactgttcccgagcatctcgtcaaccgccaggccgtgcgctccgcgcacctgatggcgcctcgatcaggggctggctgcccg

SEQ ID NO: 18282 - RNA, 132 nt, unidentified
  source 1..132: mol_type = other RNA; note = Related to NZ_VLKF01000001.1; note = Modestobacter roseus
ggcaggacgaccggcgtggaccggtcaccccggggcaaccccgggggtcgtgttcggacccagcatctcgtcacccgcccggccgtgcgctccgcgcacctggtggcgcctcgatcaggggctggctggccg

SEQ ID NO: 18283 - RNA, 133 nt, unidentified
  source 1..133: mol_type = other RNA; note = Related to NZ_JPMX01000077.1; note = Modestobacter caceresii
ggcaggacgaccggcagcagccggtcaccccggggcaaccccggggcatcgtgagcaggtcgggcatcgcgtcatgagccgcgctgtgcgctccgcgcaccaggcggcgcctccagcgaggagcggctggccg

SEQ ID NO: 18284 - RNA, 133 nt, unidentified
  source 1..133: mol_type = other RNA; note = Related to NZ_SJEX01000063.1; note = Modestobacter excelsi
ggcaggacgaccggcacgagccggtccccccatggcaaccccggggcatcgtgagaagcccaggcacggcgtcatgagccggacggcgcgctccgcgcacgcaacggcacatcgcccagggacgggctggtct

SEQ ID NO: 18285 - RNA, 133 nt, unidentified
  source 1..133: mol_type = other RNA; note = Related to JAAGWH010000033.1; note = Modestobacter muralis
gccaggacgaccggcagcgtccggtcaccccggggcaaccccggggacccgtgaagaggtcaggcacagcgtcatgagccatgccgtgcgctccgcgcacccagtggcacgtcccccagggactggctggtct

SEQ ID NO: 18286 - RNA, 134 nt, unidentified
  source 1..134: mol_type = other RNA; note = Related to NZ_VNHW01000003.1; note = Blastococcus xanthinilyticus
ggcaggacgaccggcgaggagccggtccctccggggctaccccggggtctcgcagcagagctgggcgatgcgccacccgccggacggcgcgctccgcgcacgtcccggcacctccgtcagggagcggctgccct

SEQ ID NO: 18287 - RNA, 133 nt, unidentified
  source 1..133: mol_type = other RNA; note = Pseudonocardiales bacterium; note = Related to QHCB01000177.1
ggcaggttggtcgggaccacccgatcactccggggcaaccccggggtcatcactcgacgcaggccatcgcgtcgcacgcccgctactgcgccctacgcaagcctgggcgcgcacggcagggattggctgcctc

SEQ ID NO: 18288 - RNA, 133 nt, unidentified
  source 1..133: mol_type = other RNA; note = Actinomycetia bacterium; note = Related to JAFKEJ010000505.1
ggcaggacggtcgggctcgctcgaccactccggggcaaccccggggtcatcgaccggcaccacgcatcgcatcgcccgccacgaagttcacctcgtgaacgagccggcgggcacatcggaggttggctggccg

SEQ ID NO: 18289 - RNA, 132 nt, unidentified
  source 1..132: mol_type = other RNA; note = Related to NZ_FQVU01000005.1; note = Jatrophihabitans endophyticus
ggcaggacgatcgggtgcaccgatctctccggggcaaccccgggggcgcaaccgcacgcgaggcactgcgtcgcgagccagggcctgcactgcgtgcagcggcaggcacgcacgacagcgaagggctaccgc

SEQ ID NO: 18290 - RNA, 135 nt, unidentified
  source 1..135: mol_type = other RNA; note = Related to BOMC01000025.1; note = Actinoplanes abujensis
cctgagctggccgtcgcacgacgacggctcttcggggcaaccccgagggagttcgcttgaccaccacagcgcatcgccggcgcgccgcagcgcttcgcgcagggcggcgcaggcacgaccgggattcgtcggggc

SEQ ID NO: 18291 - RNA, 147 nt, unidentified
  source 1..147: mol_type = other RNA; note = Related to JAHKKG010000005.1; note = Actinoplanes bogorensis
cccgagctggccgtcgcccgccggaaacggcggcgagggtctcttcggggtaaccccgagggcgtccagtgatcaccgcagcgcatcgccggcgcgcctcagcgcttcgcgcagcacggcgcaggcacgaccgggcttcgtcgggac

SEQ ID NO: 18292 - RNA, 147 nt, unidentified
  source 1..147: mol_type = other RNA; note = Related to NZ_JAHWFK010000003.1; note = Actinoplanes sp.
cctgagctggccgtcgaccgccgttcgcggcggcgagggctcttcggggcaaccccgaggacgcttgattgagcaccgcagcgcatcgccggcgcgacgcagcgcttcgcgcggcactgcgcaggcacgaccgggaatcgtcagggc

SEQ ID NO: 18293 - RNA, 148 nt, unidentified
  source 1..148: mol_type = other RNA; note = Related to NZ_OBDY01000014.1; note = Actinoplanes atraurantiacus
cccgagctcgaccgtcgcccgtcgttccggcggcgagggtctctccggggtaaccccggggaagcttgagtgaccaccgcagcgcatcgccggcgcgcctccgcgcttcgcgcagcccggcgcaggcacgaccgggaatcgtcggggc

SEQ ID NO: 18294 - RNA, 147 nt, unidentified
  source 1..147: mol_type = other RNA; note = Related to AP023356.1; note = Actinoplanes ianthinogenes
cccgagctggccgtcgcacgccgttcccggcggcgagggctcttcggggtaaccccgaggacgcaggattgactaccgcagcgcatcgccggcgcgcgtcagcgcttcgcgcagcacggcgcaggcacgaccgggcatcgtcggggc

SEQ ID NO: 18295 - RNA, 149 nt, unidentified
  source 1..149: mol_type = other RNA; note = Related to NZ_JOJL01000057.1; note = Actinoplanes sp.
cccgagctggcgctcgcccgtcgcttcgcggcggcgagggtctcttcggggtaaccccgaggaagcttgattgactaccgcagcgcatcgccggcgcgcttcagcgcttcgcgcagcacggcgcaggcacgaccgggattcgtcgggac

SEQ ID NO: 18296 - RNA, 135 nt, unidentified
  source 1..135: mol_type = other RNA; note = Related to NZ_BOMY01000054.1; note = Actinoplanes tereljensis
cccgagctggccgccgcactccggtggctcttcggggtaaccccgaggaagcaggtttgactaccgcaccgcatcgccggcgcacgtccgcgcttcgcgcggctcggcgcaggcacgaccgggaatcgtcggggc

SEQ ID NO: 18297 - RNA, 147 nt, unidentified
  source 1..147: mol_type = other RNA; note = Related to NZ_RJAC01000023.1; note = Actinoplanes sp.
cccgagctcgccgtcggccgtcgttcgcggcggcgatggctcttcggggtaaccccgaggacgtttctgtgagcaccgcagcacaccgccggcgcgcttccgcgcttcgcgcagtccggcgcaggcacgaccgggaatcgtcggggc

SEQ ID NO: 18298 - RNA, 147 nt, unidentified
  source 1..147: mol_type = other RNA; note = Related to JAENHP010000015.1; note = Actinoplanes ovalisporus
cccgagctggccgtcgtccgccgtgagcggcggcgagggctcttcggggtaaccccgaggaagcaggattgaccaccgcagcgcatcgccggcgcgccgcagcgcttcgcgctggacagcgcaggcacgaccgggaatcgtcggggc

SEQ ID NO: 18299 - RNA, 150 nt, unidentified
  source 1..150: mol_type = other RNA; note = Related to NZ_QHHV01000069.1; note = Actinoplanes sp.
cccgagctgaccgtcgcgcgccgtccgcggcgcgccgagggtctcttcggggtaaccccgagggcgcaggattgatcaccgcagcgcatcgccggcgcgcccctgcgctccgcgcaggacggcgcaggcacgaccgggcatcgtcggggc

SEQ ID NO: 18300 - RNA, 150 nt, unidentified
  source 1..150: mol_type = other RNA; note = Related to BOQL01000058.1; note = Actinoplanes auranticolor
cccgagctgaccgtcgcgcgccgcccgcggcgcgacgagggtttcttcggggtaaccccgagggcgcaggattgaccaccgcagcgcatcgccggcgcgcctctgcgcttcgcgcagctcggcgcaggcacgaccgggcatcgtcggggc

SEQ ID NO: 18301 - RNA, 128 nt, unidentified
  source 1..128: mol_type = other RNA; note = Related to NC_022657.1; note = Actinoplanes friuliensis
cccgagctgaccctcacgggtctctccggggtaaccccggggcgaacaggtgactaccgcagcgcatcgccggcgcctcgccgcgcttcgcgcgagaacgcgcaggcacgaccgggtttcgtcggggc

SEQ ID NO: 18302 - RNA, 137 nt, unidentified
  source 1..137: mol_type = other RNA; note = Related to NZ_RJKL01000001.1; note = Couchioplanes caeruleus
cccgagctggccgccggtccgccgacggcctctccggggtacccccgggggcgagagattgagccacgcagcgcatcgccggcgcgccgccgcgctccgcgcgggacagcgcaggcacgaccgggcaacgtcggggc

SEQ ID NO: 18303 - RNA, 139 nt, unidentified
  source 1..139: mol_type = other RNA; note = Related to CP005929.1; note = Actinoplanes sp.
ggcgagccggccgccggtacaccgacggtctctccggggcacccccgggggcgcacatccttcgctgggcagcacaccgccggcacgtcattcgcgctccgcgcgagccggtgcgggcacgaccaggcatcgtcggccc

SEQ ID NO: 18304 - RNA, 135 nt, unidentified
  source 1..135: mol_type = other RNA; note = Related to NZ_LOJP01000001.1; note = Actinoplanes sp.
cccgagctgaccgtcgcttcggcgaggtctctccggggcacccccggggacgaaagtgtgagttcgcaccgcaccgccggcactcgcccgcgcttcgcgcgacaccgtgcaggcacaaccgggattcgtcgggac

SEQ ID NO: 18305 - RNA, 138 nt, unidentified
  source 1..138: mol_type = other RNA; note = Related to NZ_BOMN01000001.1; note = Actinoplanes humidus
cccgagcttgaccgccggtccgccgacggtctctccggggcaaccccgggggcgacatgatcagccaggcacagcaccgccggcgtgcccccgcgctccgcgcggcacgacgcaggcacaaccgggcatcgtcgggcc

SEQ ID NO: 18306 - RNA, 150 nt, unidentified
  source 1..150: mol_type = other RNA; note = Related to NZ_BOPH01000102.1; note = Virgisporangium ochraceum
cccgagctggccggagcgcgtcgtccgcggcgcgccgacggcctcttcggggcaaccccgaggacgacgcagtgagcaccgcagcgcatcgccggcgcgcatccgcgctccgcgcaggacggcgcaggcacgacggggcatcgtcgggac

SEQ ID NO: 18307 - RNA, 150 nt, unidentified
  source 1..150: mol_type = other RNA; note = Related to NZ_BOPG01000148.1; note = Virgisporangium aurantiacum
cccgagctggccggagcgcgccgttcacggcgtgccgacggcctcttcggggcaaccccgaggacgacgcagtgagcacggcagcgcatcgccggcgcgcaccagcgcttcgcgcaggacagcgcaggcacgacggggcatcgtcgggac

SEQ ID NO: 18308 - RNA, 138 nt, unidentified
  source 1..138: mol_type = other RNA; note = Related to NZ_JADMLH010000017.1; note = Pseudosporangium sp.
cccgagcaggccgccggatcgccgacggtctctccggggcacccccgggggcgagcacattgagccacgcagcgcttcgccggcgcgccaccgcgctccgcgcgagacagcgcaggcacgaccgggcatcgtcggggc

SEQ ID NO: 18309 - RNA, 129 nt, unidentified
  source 1..129: mol_type = other RNA; note = Related to NZ_JNYJ01000032.1; note = Dactylosporangium aurantiacum
cccgagcagaccagcgatggtcgctccggggtaaccccggggacgcaggattgagcacggcagcacatcgccggcgcgcctccgcgcttcgcgcgactctgcgcaggcacgaccgggattcgtcggggc

SEQ ID NO: 18310 - RNA, 135 nt, unidentified
  source 1..135: mol_type = other RNA; note = Related to NZ_CP061913.1; note = Dactylosporangium vinaceum
cccgagctgatcgcggctcgccgtgatcgctccggggcaaccccgggggcgcagtgatgagcaccgcagcacaccgccggccctcagccgcacttcgtgcgacaccgggcaggcacgaccgggcaacgtcggggc

SEQ ID NO: 18311 - RNA, 135 nt, unidentified
  source 1..135: mol_type = other RNA; note = Related to NZ_BMPI01000004.1; note = Dactylosporangium sucinum
cccgagccggccaggggcgaccttggcctctccgggggaaccccggggacgcaggattgagcaccgcacagcaccgccggcccgacgccgcgctccgcgcaggccagggcaggcacgaccgggtgtcgtcggggc

SEQ ID NO: 18312 - RNA, 153 nt, unidentified
  source 1..153: mol_type = other RNA; note = Related to NZ_JAGGJO010000001.1; note = Micromonospora sp.
cccgagctgaccaggccggccccccacgtggggtccggtcatggtctctccggggcaaccccggggacggactactcacctcggcaccacaccacaggtgcgtcggcacgctccgcgagcctgtgcacccgcacgaccgggcatcgtcgggac

SEQ ID NO: 18313 - RNA, 153 nt, unidentified
  source 1..153: mol_type = other RNA; note = Related to VDFY01000230.1; note = Micromonospora orduensis
cccgagctgaccaggccgctcccccacgtggagtccggtcacggtctctccggggcaaccccggggacgcgatactcacctcggcaccacaccacaggtgcgtcggcacgctccgcgagcctgtgcacccgtacgaccgggcatcgtcgggac

SEQ ID NO: 18314 - RNA, 153 nt, unidentified
  source 1..153: mol_type = other RNA; note = Related to NZ_RAQQ01000031.1; note = Micromonospora globbae
cccgagctggccaggctgcgtccccgcgtggggcgcggtcacggtctctccggggtaaccccggggacgtcacactcacctcggcaccacaccacaggtgcgtcggcacgctccgcgagcctgggcacccgcacgaccgggcatcgtcgggac

SEQ ID NO: 18315 - RNA, 153 nt, unidentified
  source 1..153: mol_type = other RNA; note = Related to POTY01000051.1; note = Micromonospora craterilacus
cccgagctgaccaggccgctcccccaggcggggcgcggtcacggtctctccggggcaaccccggggacgcaacactcacccaggcaccacaccacaggtgcgtcggcacgctccgcgagcctgtgcacccgcacggccgggcatcgtcgggac

SEQ ID NO: 18316 - RNA, 153 nt, unidentified
  source 1..153: mol_type = other RNA; note = Related to NZ_QUMQ01000001.1; note = Asanoa ferruginea
cccgagctgaccgtgccgcgtctccgctggaggcggggcgatggtctctccggggcaaccccgggggcgtgttgtctacctgagcaccacaccgcaggtgcgcgggcacgcttcgcgaacctctgcacccgcacgaccgggcatcgtcggggc

SEQ ID NO: 18317 - RNA, 141 nt, unidentified
  source 1..141: mol_type = other RNA; note = Related to NZ_BONC01000044.1; note = Asanoa iriomotensis
cccgagccgaccgtgccgcgcgtcggccacggtctctccggggcaaccccgggggcgtgtcacctacctgagcaccacaccgcaggtgcgccagcacgcttcgcgagcctctgcacccgcacgaccgggcatcgtcgggac

SEQ ID NO: 18318 - RNA, 153 nt, unidentified
  source 1..153: mol_type = other RNA; note = Related to NZ_LT607412.1; note = Micromonospora coriariae
cccgagctgacctggccgcgcccccaccggggacgcggtcggagtctctccggggcaaccccgggggcggcacatccacctgggcaccacaccacaggtgcgtcggcacgctccgcgagcctgtgcacccgtacgaccgggattcgtcggggc

SEQ ID NO: 18319 - RNA, 144 nt, unidentified
  source 1..144: mol_type = other RNA; note = Related to NZ_AP023359.1; note = Polymorphospora rubra
cccgagctgaccaggccgcgtccgcgcggtcccggtctctccggggaaaccccggggacgtcacccgtaccaccgcatcgcgtcgcctgcgctccggtgcgctccgcgcacgtccgcgcacgcacgaccgggcctcgtcgggac

SEQ ID NO: 18320 - RNA, 151 nt, unidentified
  source 1..151: mol_type = other RNA; note = Micromonosporaceae bacterium; note = Related to JADGGF010000365.1
cccgagctgaccaggacgccgtcctcggcgacggcccaccggtctctccggggtaaccccgggggcgtcacaggtatctccccgcggcaccacatgcgcgacccggcgcttcacgccgcacggcgcacgtacgacagggaaccgtcggggc

SEQ ID NO: 18321 - RNA, 143 nt, unidentified
  source 1..143: mol_type = other RNA; note = Actinomycetia bacterium; note = Related to JAHBSN010000079.1
accgagtcggtcggatggagcttcggcgtcgtccgacctctccggggcacccccggggacgaccacgtggtcacacatcgcatcgccggcgcgctcgcgcactccgtgcgcccaggcgccagcacgacaggacgggtcgggag

SEQ ID NO: 18322 - RNA, 134 nt, unidentified
  source 1..134: mol_type = other RNA; note = Frankiaceae bacterium; note = Related to JAFAZI010000149.1
tacgagctcgtcgaggtcgcactcgaccgccccggggctaccccggggttgattcgtcatgtcaggcattccttcgcacgtgcggcggcgcactccgtgcacgcaagcacgcgcacggcaggactggtcggacg

SEQ ID NO: 18323 - RNA, 133 nt, unidentified
  source 1..133: mol_type = other RNA; note = Related to JACGZW010000002.1; note = Amycolatopsis dendrobii
ggtgagccggtggaggaccacccactccggggcaaccccggggagcagcacgacacgtacccacagcgccccgcgcagcggcggcacgctccgcgtgcgagacagcgcggatgaacggagaacgagtcgcctc

SEQ ID NO: 18324 - RNA, 133 nt, unidentified
  source 1..133: mol_type = other RNA; note = Related to NZ_PDJK01000002.1; note = Amycolatopsis sulphurea
ggtgagccggtggaacaccacccactccggggcaaccccggggagcagtacggcacgcaaacaccgcaccccacgcgaacgcggcacgctccgcgtacaagaccgcgcggatgaacggagaaagagtcacctc

SEQ ID NO: 18325 - RNA, 134 nt, unidentified
  source 1..134: mol_type = other RNA; note = Related to NZ_CP080519.1; note = Amycolatopsis sp.
ggtgagcccggtggagaaccaccccttccggggcaaccccggaacgcaccacatcacccgatcacagcgccccacgcgagggcggcacgctgcgcgtacaagaccgcgcggatgaacggagaaagagtcacccc

SEQ ID NO: 18326 - RNA, 134 nt, unidentified
  source 1..134: mol_type = other RNA; note = Related to NZ_FOEF01000001.1; note = Amycolatopsis saalfeldensis
ggtgagcccggtggagaaccaccctctccggggttaccccggggtgcacgaggacacgcaggcacagcgccccgcgcgaacgcggcacgctccgcgtacaggaccgcgcggatgaacggagaatcagtcacctc

SEQ ID NO: 18327 - RNA, 133 nt, unidentified
  source 1..133: mol_type = other RNA; note = Related to NC_021252.1; note = Amycolatopsis keratiniphila
ggtgagccggtggatcaccacccactccggggcaaccccggggagtacgaagtcagccaggcaaggcgccccgcgcgagcgcggcatgcttcgcgtacgagtccgcgcggatgacaggagaaagagtcacccc

SEQ ID NO: 18328 - RNA, 133 nt, unidentified
  source 1..133: mol_type = other RNA; note = Related to NZ_ARVW01000001.1; note = Amycolatopsis nigrescens
ggtgagcaggtggaacaccacccactccggggcaaccccggggagcacgaggacacgcaggcatcgcgccccgcgcgaacgcggcacgcttcgcgtacaagaccgcgcggatgaacggagaaaaggtcacctc

SEQ ID NO: 18329 - RNA, 137 nt, unidentified
  source 1..137: mol_type = other RNA; note = Related to NZ_FNON01000006.1; note = Amycolatopsis xylanica
gatgagcaaggtggagcgatccgcccgctccggggcaaccccggggcgcaccatggcacccgcgcacggcaccccacgccgatggggcacgctccgcggacgacgcggcgcggtcgaacggagaacgaggtcatctc

SEQ ID NO: 18330 - RNA, 133 nt, unidentified
  source 1..133: mol_type = other RNA; note = Related to CP090063.1; note = Amycolatopsis acidiphila
ggtgagcaggtggatcaccaccccctccggggcaaccccggggagcttcaggacacgcaggtatggcgccccacgcgaacgcggcacgcttcgcgtacagaaccgcgcggatgaacggagaaaaggtcacctc

SEQ ID NO: 18331 - RNA, 135 nt, unidentified
  source 1..135: mol_type = other RNA; note = Related to NZ_NKYE01000001.1; note = Amycolatopsis antarctica
ggtgagcaggtgggagttcccgcccgctccggggcaaccccggggagatcgaccagaggtaggcatcgcgccccacgcgcgcgagcatgctccgcgtacctgatgcgcgcggagacacggagaaaaggtcacccc

SEQ ID NO: 18332 - RNA, 135 nt, unidentified
  source 1..135: mol_type = other RNA; note = Related to NZ_JAENJH010000016.1; note = Prauserella cavernicola
ggtgagcaggtgggaggacccacccactccggggcaaccccggggagctcgacatcggatgacgatcgcgccccacgcgcgtacgcatgctccgcgtggctccggcgcgaggacgaacggagatgcggtcacctc

SEQ ID NO: 18333 - RNA, 135 nt, unidentified
  source 1..135: mol_type = other RNA; note = Related to NZ_MASU01000002.1; note = Prauserella flavalba
ggtgagcaggtgggacgacccacccactccggggcaaccccggggagctcgacatcggcagggcaccgcgccccacgcgcgcccgcatgctccgcgtggcccaagcgcgcggacgaacggagacgaggtcacctc

SEQ ID NO: 18334 - RNA, 135 nt, unidentified
  source 1..135: mol_type = other RNA; note = Related to VIVS01000002.1; note = Prauserella muralis
ggtgagcaggtggggtcacccacccactccggggcaaccccggggagcccggcatcggttgagcactgcgccccacgcgcggcgccatgctccgcgtgcgatcggcgcgcgggagagcggagacgaggtcacctc

SEQ ID NO: 18335 - RNA, 140 nt, unidentified
  source 1..140: mol_type = other RNA; note = Related to NZ_CP059997.1; note = Amycolatopsis sp.
ggtgagcagatggggacacccatccctccggggcaaccccggggagcacgaccacgctgaggcacggcgccccacgcgcgtgtgcacgctgcgcgtacctgttgggagcgcgcggacggccacgggagaaaggtcacctc

SEQ ID NO: 18336 - RNA, 141 nt, unidentified
  source 1..141: mol_type = other RNA; note = Related to NZ_VTHK01000003.1; note = Amycolatopsis anabasis
ggtgagcaggcggggtcacctgcccactccggggcaaccccggggagcacgacgaaacccaggcatcgcgccccacgcgcgacagcacgctccgcgtacgccttggtgcgcgcggcagaacaggggagaaacggtcacctc

SEQ ID NO: 18337 - RNA, 144 nt, unidentified
  source 1..144: mol_type = other RNA; note = Related to NZ_JACHMH010000001.1; note = Crossiella cryophila
agcgagacgaggggtggcccagtgctcgcccttccctccggggataccccggggagcagtgtttcagctggtcagtgcgccccgcgtggatcggcacgctccgcgtgcgagccccacgcggctcacgatggcagaggtcgcccc

SEQ ID NO: 18338 - RNA, 135 nt, unidentified
  source 1..135: mol_type = other RNA; note = Related to NZ_RBXR01000001.1; note = Saccharothrix variisporea
agcgagcaggcggttggaacaccgcccctcaggggcaacccctgggagcacgacccgaagaacccactgcgccccaggcagaacggcacgctccgcgtgcttggctgcccgaagtggcggagaaggcgtcgcgcc

SEQ ID NO: 18339 - RNA, 136 nt, unidentified
  source 1..136: mol_type = other RNA; note = Related to JAAATY010000004.1; note = Kibdelosporangium persicum
ggtgagcacggtggtgaacaccacccctctggggttaccccagggagcacggcattaccggaggatggcgccccacgcgcgacggcacacgctgtgtacgtgcgtgcgcgcggacatcgggagaacgagtcactcc

SEQ ID NO: 18340 - RNA, 136 nt, unidentified
  source 1..136: mol_type = other RNA; note = Related to JADBEI010000001.1; note = Kibdelosporangium phytohabitans
ggtgagcacggtggtgagaaccacccctctggggataccccagggagcaaggcattacctgcggttggcgccccacgcgcggcggcacactccgtgtacgtgggtgcgcgcggatatcgggagatggagtcactcc

SEQ ID NO: 18341 - RNA, 136 nt, unidentified
  source 1..136: mol_type = other RNA; note = Related to NZ_FWXV01000002.1; note = Kibdelosporangium aridum
agtgagcacggtggtgaacaccacccctctggggctaccccagggagcacggatttacctgcggatggcgccccacgcgcgacagcacacgctgtgtacgcatgggcgcgcggatatcgggagaacaggtcacttc

SEQ ID NO: 18342 - RNA, 133 nt, unidentified
  source 1..133: mol_type = other RNA; note = Related to JAGINW010000001.1; note = Kibdelosporangium banguiense
ggtgagcaggtggaacatcacccctccggggtaaccccggggagcacggtattatctgggcatgacaccccacgcgcgtcggtacgctccgcggatccaggggcgcgcggatatcgggagaaagagtcacttc

SEQ ID NO: 18343 - RNA, 142 nt, unidentified
  source 1..142: mol_type = other RNA; note = Related to AM420293.1; note = Saccharopolyspora erythraea
gccgaggcgtccggtgccgggcgggcaccgctccgaggcaacctcggggagtaccaacgcagtcgagcacggcgtccgacgcgccactgggagacgctgccgcgtctgtccgcgcgccggggaacgcagatcgggtcgccgc

SEQ ID NO: 18344 - RNA, 140 nt, unidentified
  source 1..140: mol_type = other RNA; note = Related to NZ_CP007155.1; note = Kutzneria albida
agcgagcaggcgggcaaccgtcactccggggcaaccccggggagcaccaccacagcggggcatggcgccccgcgcgcaacaccaccgctgcacgctccgcgtgaccaccgcgcgcggccgtggcgagaacaggtcgccgc

SEQ ID NO: 18345 - RNA, 158 nt, unidentified
  source 1..158: mol_type = other RNA; note = Related to NZ_JAJGSX010000003.1; note = Pseudonocardia sp.
aacgagacggcgagaacctgcccgtgcacgtcacggcaggccttgctgctccggggcaaccccggggtgcaccacttctgcgcagcatggcgtcccgcgcgcgcgaggcacaggaagagtgccgacggcgcgcggcggacgggaacaccggtcgctcg

SEQ ID NO: 18346 - RNA, 158 nt, unidentified
  source 1..158: mol_type = other RNA; note = Related to NZ_JAAXKY010000083.1; note = Pseudonocardia xinjiangensis
gacgagacggcgagcacccgcccaagcaccacccggcgggtctcgtggctccggggcaaccccggggtgcaccacctctctgcggcatggcgtcccgcgcaccccgggcacgaacgcagtgccgtcagtgcgcggccgacgggaacaccggtcgtcgc

SEQ ID NO: 18347 - RNA, 152 nt, unidentified
  source 1..152: mol_type = other RNA; note = Related to NZ_JADQDF010000001.1; note = Pseudonocardia oceani
gtcgagacggcgagcacccggcccccacggcgggtctcgtggctccggggcgaccccggggtgcaccacctcagtgcggcacggcgtcccacgcaggacgggcaggtacggcatgccccctctgcgcggcggacgggaacaccggtcgtccg

SEQ ID NO: 18348 - RNA, 152 nt, unidentified
  source 1..152: mol_type = other RNA; note = Related to NZ_CP013854.1; note = Pseudonocardia sp.
gacgagtgggcggtcgtcccggctccggccggggcccgcggctccggggtgaccccggggtgcaccggtactgcgcagcacggcgtcccgcgcgcgtcgggcaggacagcgctgcctgcggcgcgcggcggacagcgaacacgggtcgtcgg

SEQ ID NO: 18349 - RNA, 124 nt, unidentified
  source 1..124: mol_type = other RNA; note = Related to BEGX01000057.1; note = Pseudonocardia sp.
ggcgcggatcgcggctccggggaaaccccggggtgcaccacctcagcgggccatcgcgtcccgcgcgtgcggtcactgctcccgcgtgagtctgcgcgcggcggacaggaacccaggtcgaccg

SEQ ID NO: 18350 - RNA, 129 nt, unidentified
  source 1..129: mol_type = other RNA; note = Related to NZ_BJVJ01000106.1; note = Pseudonocardia sulfidoxydans
gtcgcggctcggatcgcggccccggggcaaccccggggtgcaccggttcagcggggcacggcgtcccgcgcgcgtggtcactgctcgcgcgtgagtctgcgcgcggcggacaggaacacaggtcgaccg

SEQ ID NO: 18351 - RNA, 163 nt, unidentified
  source 1..163: mol_type = other RNA; note = Related to CP002593.1; note = Pseudonocardia dioxanivorans
gacgagtcggcggtccggtgtggtggtctcggccaccacggcgcggaccgcggctccggggcaaccccggggtgcaccttctcagcgggactcggcgtcccgcgcgcgtggtcactgctcccgcgtgagtctgcgcgcggcggacaggaacccaggtcgaccg

SEQ ID NO: 18352 - RNA, 154 nt, unidentified
  source 1..154: mol_type = other RNA; note = Related to NZ_FNBE01000010.1; note = Pseudonocardia oroxyli
gacgagtcggcgaaccgtcgggccctcgggcccggccttcgcggctccggggcaaccccggagtgcaccatccctgcaccgcacggcgtcccgcgcgcggcggcccgcaccacggggacgtgggcgcgcggcggacgagagcccaggtcgtacg

SEQ ID NO: 18353 - RNA, 145 nt, unidentified
  source 1..145: mol_type = other RNA; note = Related to NZ_JIAI01000002.1; note = Pseudonocardia acaciae
gtggagtcggcgtgggccccgttcgcggggcggcgtcggtccggggcaaccccgggcagcaggtactcagcaccgcatggcgtcccgcgcgcgaccgcacggttggtgccccggcgcgcggatgacagggagaaccggtcctccg

SEQ ID NO: 18354 - RNA, 144 nt, unidentified
  source 1..144: mol_type = other RNA; note = Betaproteobacteria bacterium; note = Related to REAM01000105.1
gtctagctttgttgcaatcgattcttcgatgacattgcggacgcgcggggttaccccgcgtgacaacttatcgatactttcccggcgcggttggcggtgcgtcttcgccgcacacataaccgcgatccgacacgcggtagacgc

SEQ ID NO: 18355 - RNA, 132 nt, unidentified
  source 1..132: mol_type = other RNA; note = Related to JAHQVJ010000021.1; note = Myxococcales bacterium
cccgagcatccgaggtctcgatctcgaccctggggctaccccagggctgttccacaacctagcttccaccggcccacggcacgcgctgcgcgttgcgcagaacacgccgcggcgggccagatccgtcgggga

SEQ ID NO: 18356 - RNA, 129 nt, unidentified
  source 1..129: mol_type = other RNA; note = Deltaproteobacteria bacterium; note = Related to JACKEN010000003.1
tccgagtgatggggtcttggacctccctccgggggacccccgggggcgtaaactgagcttgcatctacgtcaccgcggcctcggtccgcggtcacggacggcagccgcggcagaccggcgagtcggggt

SEQ ID NO: 18357 - RNA, 132 nt, unidentified
  source 1..132: mol_type = other RNA; note = Related to NZ_CP036267.1; note = Thalassoglobus polymorphus
cataagcttggtccgcaaggacactgtggggttaccccacgggagaaacgttgttcgagattcgtcggatgaagctgtgtgacggaaagcattgtttccgtcacacagcttcgccacaggatgcgttgtgca

SEQ ID NO: 18358 - RNA, 132 nt, unidentified
  source 1..132: mol_type = other RNA; note = Related to JABJMI010000419.1; note = Planctomicrobium sp.
cataagcttggtccgtaaggacactgtggggttaccccacgggagaaacgttgttcgtgattcgtcggtagacctttgctaaccgaaagcattgtttcggttagcaaaggtcgccacaggatgcgttatgca

SEQ ID NO: 18359 - RNA, 130 nt, unidentified
  source 1..130: mol_type = other RNA; note = Related to NZ_SIHI01000002.1; note = Thalassoglobus neptunius
cacaagccttgtccgttggacactgcggggttaccccgcgggagaagtgttgttcccgattcgatggatgaaggttctcaacgccaagcaagtttgcgttcagaaccttcgccacaggatgcgttgtgcg

SEQ ID NO: 18360 - RNA, 129 nt, unidentified
  source 1..129: mol_type = other RNA; note = Related to NZ_FOQD01000010.1; note = Planctomicrobium piriforme
cacaagcccggtcctctggacactgtggggttaccccacgggagaatcgttgctccgcattcggcggatgaatgttgaccacggtacgacttgtaccgtcgcaacatacgctacaggattcgttgtgca

SEQ ID NO: 18361 - RNA, 129 nt, unidentified
  source 1..129: mol_type = other RNA; note = Planctomycetaceae bacterium; note = Related to JAGQPW010000040.1
cacaagctctgtccctcgggacattgtggggataccccacgagagatgcgttgttcgattctcatcggtagaagattgccgacgggcagaattgcccgtcgcaatcttcgccacaggattcgttgtgcg

SEQ ID NO: 18362 - RNA, 129 nt, unidentified
  source 1..129: mol_type = other RNA; note = Planctomycetaceae bacterium; note = Related to JAGQQB010000156.1
cacaagccctgtccttcgggacattgtggggttaccccacgagtgaagtgttgttcgattctcattggaagaagcttggcagcgacgagatgtcgtcgccgcaagcttcgccacaggattcgttgtgcg

SEQ ID NO: 18363 - RNA, 122 nt, unidentified
  source 1..122: mol_type = other RNA; note = Related to NZ_CP036275.1; note = Maioricimonas rarisocia
cacaagctcacaggtctgtggggctaccccacggcagaagcgttgaccgcatctcgttgcaggaatttgtcgcaacgaagacgattcgttgcagacaaattcgccacaggatccgttgtgcg

SEQ ID NO: 18364 - RNA, 130 nt, unidentified
  source 1..130: mol_type = other RNA; note = Related to JAGQQF010000427.1; note = Planctomycetaceae bacterium
cccaagctcagtccttcgggacgctgtggggataccccacggaagaagcgttgagagcatctcgtcgcgtgagtttgcaaccgacgagtcgtttcgtcggtcgcaaactcgccacaggatccgttgggcg

SEQ ID NO: 18365 - RNA, 148 nt, unidentified
  source 1..148: mol_type = other RNA; note = Planctomycetaceae bacterium; note = Related to JABISG010000096.1
cacaagaatgttcgcagtcaccttgattggtgattccggacgctgcggggttaccccgcggaagaagcgttgttcgacattcgccgcgacaatgtccttcggttaagagctttaaccgacggacattcgccacaggatcggttgtgcg

SEQ ID NO: 18366 - RNA, 133 nt, unidentified
  source 1..133: mol_type = other RNA; note = Related to JAGQPX010000026.1; note = Planctomycetaceae bacterium
gataagctgttgccgtcttcggcactgtggggttaccccacgggagaatcgttgttcccatctcgtcgcgtgaatctgtgaacggcaaagccttgtttgccgttcacagattcgccacaggatccgttacccg

SEQ ID NO: 18367 - RNA, 121 nt, unidentified
  source 1..121: mol_type = other RNA; note = Related to JAEUIG010000100.1; note = Planctomycetaceae bacterium
cataagctctcaggtctgtggggttaccccacggcagaaggcgtgtctttcattcgacagtgaggagtcacggattcggactctcgaatccgtcacacctcgccacaggatgcgttgtgcg

SEQ ID NO: 18368 - RNA, 123 nt, unidentified
  source 1..123: mol_type = other RNA; note = Related to QQVO01000002.1; note = Planctomycetes bacterium
cacaagctgtcaggtctgtggggctaccccacggcagaagcgttgttcgtcattcatgcgtgagcaaacgcgctgattgtggctcacaatcagcggtttgcccgccacaggatgcgttgtgcg

SEQ ID NO: 18369 - RNA, 136 nt, unidentified; identical to SEQ ID NO: 17810
  source 1..136: mol_type = other RNA; note = Related to NZ_CP036271.1; note = Caulifigura coniformis

SEQ ID NO: 18370 - RNA, 133 nt, unidentified
  source 1..133: mol_type = other RNA; note = Related to JAHBXW010000001.1; note = Planctomyces sp.
cacaagcgttggtcctttcgaggacgctgcggggcaaccccgcggtagaagcgttgacgatcattcatccgagaatttgtgctcggcaatgcgttgtttgccgagacaaattcgccacaggattcgttgtgcg

SEQ ID NO: 18371 - RNA, 151 nt, unidentified
  source 1..151: mol_type = other RNA; note = Planctomycetes bacterium; note = Related to VGXY01000890.1
cacaagctcgattcgcacgttcctgaccggaacgtgacgaatgctgcggggttaccccgtggtcgctgcgttgttcgagattcgtggtgtgaattgtcggacggagtcgtcagtaactccgtcgacaattcgctacgggatcagttgtgcg

SEQ ID NO: 18372 - RNA, 148 nt, unidentified
  source 1..148: mol_type = other RNA; note = Related to JACMJF010000970.1; note = Candidatus Saccharimonas sp.
cacaagctcgattcgcgcgtccctgaccggacgtgtcgaatgctgcggggttaccccgcggtcgccgtgttgttcgagattcgtggtgtgaattgtcggtgtggtggacctcaccacaccgacaattcgctacgggatcggttgtgcg

SEQ ID NO: 18373 - RNA, 151 nt, unidentified
  source 1..151: mol_type = other RNA; note = Related to JAFEBS010000049.1; note = Planctomycetes bacterium
cacaagttcaattcgcacgtccctgaccggacgtgatgaatgctgcggggttaccccgcggtcgctgcattgctcgggattcgtggtgtgaattgtcggcaacggtggactcatcaccgttgcgacaattcgctacgggatcggttgtgcg

SEQ ID NO: 18374 - RNA, 150 nt, unidentified
  source 1..150: mol_type = other RNA; note = Related to QWPM01000121.1; note = Planctomycetes bacterium
cacaagacacgtttggcctccctgacgggatgagctgaacactgcggggttaccccgcggtcgctgagttgttcctcaatcgagctgtgaagagccggcgacggtagacctcttaccgccgcggctcttcgccacgggatcggttgtgcg

SEQ ID NO: 18375 - RNA, 150 nt, unidentified
  source 1..150: mol_type = other RNA; note = Related to NZ_JH636437.1; note = Schlesneria paludicola
cacaagacacgtttggccgtccctgttcgggatgtgctaaacactgcggggttaccccgcggtcgcagagttgttcctcaatcgagctgtgaagagctgtgacggtagtcgataccgtcaacagctcttcgccacgggatcggttgtgcg

SEQ ID NO: 18376 - RNA, 127 nt, unidentified
  source 1..127: mol_type = other RNA; note = Planctomycetes bacterium; note = Related to QWPB01000058.1
gccaagccttggtccttcgggacactgcggggataccccgtggaagactcgttgttcgacattcaccgtgagtttgttcaagctgtgcgtacagtttgaacaaactcgccacaggatgcgttgagtg

SEQ ID NO: 18377 - RNA, 131 nt, unidentified
  source 1..131: mol_type = other RNA; note = Related to QWOR01000226.1; note = Planctomycetes bacterium
gccaagcttttgtccttcgggacgctgcggggttaccccgtgggagactcgttgttggtcattcaacgtgagtttgccggagttgagcttgtcgtcatctccagcaaactcgacacaggatgcgttgtgcg

SEQ ID NO: 18378 - RNA, 143 nt, unidentified; identical to SEQ ID NO: 17808
  source 1..143: mol_type = other RNA; note = Related to NZ_CP011270.1; note = Planctomyces sp.

SEQ ID NO: 18379 - RNA, 146 nt, unidentified
  source 1..146: mol_type = other RNA; note = Related to JADZEF010000283.1; note = Planctomycetaceae bacterium
cccaagctcagttcgcccgtccgcaaggatcgtcgaacgctgcggggataccccgtggaagcagtcatgtccgccattcgtggcgtgaatggtcgctccggacgcactggtccgttgcaaccattcggcacaggatccgttgtgcg

SEQ ID NO: 18380 - RNA, 142 nt, unidentified
  source 1..142: mol_type = other RNA; note = Planctomycetaceae bacterium; note = Related to JAGQPV010000469.1
cacaagtcctgttcgccagacctgttctgtcgagcactgcggggttaccccgcgggagacgcattgcgcggcattcgatccgcgaataatcggtcaggacgtccgtcctgatccgattattcggcacaggaacagttgtgcg

SEQ ID NO: 18381 - RNA, 143 nt, unidentified
  source 1..143: mol_type = other RNA; note = Planctomycetaceae bacterium; note = Related to JACCRE010000317.1
cccaagcatcgcccggggctgaaagactgcccccggcaccgcggggctaccccgcggcagacgcgttgctcaccattcgaggcgtgagccaatccgcggaccgctgggaccgcagactggctcggcacaggaccggttgggcg

SEQ ID NO: 18382 - RNA, 149 nt, unidentified
  source 1..149: mol_type = other RNA; note = Related to NC_015174.1; note = Rubinisphaera brasiliensis
cataagctcggctcgcctgttcagcattcctgaacctgcgagcgctgtggggataccccacggtcgactcattgctggctttccgcactgaatgaaacagtggttgggctttcaaccaccgtcccattcgcgacaggatcggttattca

SEQ ID NO: 18383 - RNA, 148 nt, unidentified
  source 1..148: mol_type = other RNA; note = Planctomycetaceae bacterium; note = Related to JAGQQR010000004.1
cataagctcggtctgcagggagtttaattatgacttgcagacgctgtggggttaccccatggtcgactcattgccggctttccggattgaatgaaacagcgggtggacattcacccgccgtcccattcgcgacaggatcggttattcg

SEQ ID NO: 18384 - RNA, 134 nt, unidentified
  source 1..134: mol_type = other RNA; note = Planctomycetaceae bacterium; note = Related to JAGQQT010000159.1
cataagctcggcttgtttcggcaagcgctgtggggttaccccacggtcgaatcattgttgacttctcgtcaggaaccaaagaccagtccggtcaccggactggtactttggttcgggacaggatcggttatccg

SEQ ID NO: 18385 - RNA, 133 nt, unidentified
  source 1..133: mol_type = other RNA; note = Related to NZ_SJPG01000001.1; note = Rubinisphaera italica
cataagctcggcttgcttcggcaagcgctgtggggttaccccatggtcgaatgattgttgacatttcgataggaatgaagccgtggcttggacgacaagccacagcttcattcgcgacaggatcggttatccg

SEQ ID NO: 18386 - RNA, 140 nt, unidentified
  source 1..140: mol_type = other RNA; note = Related to JAKFGB010000009.1; note = Rubinisphaera sp.
cataagctcggcttgcaggcaactgcaggcgctgtggggttaccccatggtcgattgattgttgactttacgattggaatgaaaaggcggcttgggctttcaagccacccgttttcattcgcgacaggatcggttatacg

SEQ ID NO: 18387 - RNA, 151 nt, unidentified
  source 1..151: mol_type = other RNA; note = Planctomycetia bacterium; note = Related to BJHP01000039.1
cccaagccttgttggtgagctgctttgacggcggctcaacaacgccacggggataccccgcggttgtttgcttgtgttgatttcgttgccgtaccggcaccgcgagaggagtttttctcgcacgtcggtacgctactggacccgttgagca

SEQ ID NO: 18388 - RNA, 150 nt, unidentified
  source 1..150: mol_type = other RNA; note = Planctomycetes bacterium; note = Related to VGZH01000005.1
cccaagccttgttgctgagctgctttgaccgcggctcaacaacgccccggggataccccgcggtagttcgcttgcgttgatttcgttgccgtagccggcaccgagaagtcatgttcttgccaccggctacgctactggacccgttgagca

SEQ ID NO: 18389 - RNA, 151 nt, unidentified
  source 1..151: mol_type = other RNA; note = Related to JAFEBR010000742.1; note = Planctomycetes bacterium
cacaagccctgttcggcacgctttcgggcgtaaccggacggctgtggggataccccgcagaagaataattgtcagcatttcgaatgtggattcaccgcggcggtgcgactgtgcaccgccgcgtgaatccgccacaggaacgagttgtgcg

SEQ ID NO: 18390 - RNA, 152 nt, unidentified
  source 1..152: mol_type = other RNA; note = Planctomycetia bacterium; note = Related to JACQFH010000599.1
cacaagaccggttcggcacgccttgactggcgttccgaatggctgcggggataccccgcggatgaagcattgtcagcatttcgaacgtggattcgccaacgcggagcgacactgctccgcgtcgggaatccgccacaggaacgagttgtgcg

SEQ ID NO: 18391 - RNA, 144 nt, unidentified
  source 1..144: mol_type = other RNA; note = Related to RPPR01000054.1; note = Planctomycetaceae bacterium
cacaagatacagaccggcgttcatcgcgccgggcgactgcggggataccccgcgggagaactgatgtctgactttcgcggcgcgacttgccgccggtacgaccttgtaccggccggcaagtcggccaccggaacgagttgggcg

SEQ ID NO: 18392 - RNA, 144 nt, unidentified
  source 1..144: mol_type = other RNA; note = Planctomycetaceae bacterium; note = Related to DNUF01000128.1
cacaagctgctgtttggcgcttcccgcgtcaaacgactgcggggttaccccgcgggagagtcattgtctgccattcgtatgggaagcgccgtgcggtacgaccctgcacacgcacgacgcttcgccacaggaacgagttgggcg

SEQ ID NO: 18393 - RNA, 150 nt, unidentified
  source 1..150: mol_type = other RNA; note = Related to NZ_SJPP01000003.1; note = Symmachiella macrocystis
cacaagatttgaccgatcctaccttgaccggtatgtcggtctgctgcggggctaccccgcggaagccacattgtttcacattcgatcgtgaatcgtgactcacgtggatcgtcacgtgagtcacgattcgccacaggaagcagttgttcc

SEQ ID NO: 18394 - RNA, 132 nt, unidentified
  source 1..132: mol_type = other RNA; note = Related to JAGQQA010000064.1; note = Planctomycetaceae bacterium
cacaagattcattcctctggaatgactgtggggctaccccacggaagattgattgttctggattcgcgacgtgaatagtcgtctgcggcaggatctcccgcagagactattcggcacaggaaaagttgtgcg

SEQ ID NO: 18395 - RNA, 147 nt, unidentified
  source 1..147: mol_type = other RNA; note = Planctomycetaceae bacterium; note = Related to SIAF01000026.1
cacaagccagtttcgacacgccctgaccggcgtggcgaacgctgcggggttaccccgcggacgtgtgattgccagacattcgatcgtggatattgccgtcgggagacggtcccgacggcaatatccgccacaggaatcagttgtgcg

SEQ ID NO: 18396 - RNA, 152 nt, unidentified
  source 1..152: mol_type = other RNA; note = Related to NZ_CP037422.1; note = Gimesia aquarii
cacaagttctgactctaactgaatcctgacggatcacttagagtactgcggggataccccgtgggagaagtattgaccattctacgatatgtgaagtatcgctacgatagactcttatcgtagcaatacttcgctacaggatcggttgtgcg

SEQ ID NO: 18397 - RNA, 152 nt, unidentified
  source 1..152: mol_type = other RNA; note = Related to NZ_CP037920.1; note = Gimesia aquarii
cacaagttctgactctaactgaatcctgacggatcacttagagtactgcggggataccccgtgggagaagtattgaccattctacgaaatgtgaagggtcgctacgatagactcttatcgtagcaacccttcgccacaggatcggttgtgcg

SEQ ID NO: 18398 - RNA, 152 nt, unidentified
  source 1..152: mol_type = other RNA; note = Related to NZ_CP037452.1; note = Gimesia fumaroli
cacaagttctgactctgattgtatcctgacggatcgctcagagcactacggggataccccgtgggagaagtattgaccattctacgacacgtgaagtatggctacgatagatggttatcgtagcaatacttcgccacaggatcggttgtgcg

SEQ ID NO: 18399 - RNA, 152 nt, unidentified
  source 1..152: mol_type = other RNA; note = Related to NZ_CP036353.1; note = Gimesia maris
cacaagttctgactctgactgaatcttgacggatcgctcagagttctgcggggataccccgtgggagaaggattgaccatgcatcgacacttgaagtgtcgctacgatagacgcttatcgtagcaacacttcgtcacaggatcggttgtgcg

SEQ ID NO: 18400 - RNA, 152 nt, unidentified
  source 1..152: mol_type = other RNA; note = Related to NZ_VTSR01000009.1; note = Gimesia chilikensis
cacaagctctgactctgaatgaatcctgaccgatttctcagagcactgcggggataccccgcgggagaagaattgaccagactacgacaggtgaagtgtcgcaacgaaagaccattttcgttgcaacacttcgtcacaggatgggttgtgcg

SEQ ID NO: 18401 - RNA, 136 nt, unidentified; identical to SEQ ID NO: 17804
  source 1..136: mol_type = other RNA; note = Related to CP036268.1; note = Planctomycetes bacterium Pan189

SEQ ID NO: 18402 - RNA, 149 nt, unidentified
  source 1..149: mol_type = other RNA; note = Related to NZ_CP036316.1; note = Calycomorphotria hydatis
cccaagttcagtcgccccgtctcatacggcgggcagtcgacactacggggttaccccgtggtagaattattgctcacttggcgtcgcgagtgcgtgcccaatcggttgatgaaccgattgagcacgcacggtacaggaagcgttgagcg

SEQ ID NO: 18403 - RNA, 145 nt, unidentified
  source 1..145: mol_type = other RNA; note = Related to JAGQQC010000202.1; note = Planctomycetaceae bacterium
cccaagatttggctcgccatccgcaaggatgccagccgctgtggggataccccacggtcgaagaattgcacgacattcgttcccggaagattgaagttgtatagaagttatacaattaaatcttcgcgacaggatgcgttgagcg

SEQ ID NO: 18404 - RNA, 145 nt, unidentified
  source 1..145: mol_type = other RNA; note = Related to NZ_CP036281.1; note = Polystyrenella longa
cccaagcccaggtttgccatccgcaaggatgacagccgctgtggggataccccacggtagaagagttgcttgacactcgttcccggaaggtgttaccgactagaagttagtcggtctacaccttcgcaacaggatccgttgagcg

SEQ ID NO: 18405 - RNA, 141 nt, unidentified
  source 1..141: mol_type = other RNA; note = Related to LYDR01000158.1; note = Planctopirus hydrillae
cacaagaagaggccatatcgctgaaaagcctggccggtgcggggttaccccgtgctcgaatgattgctcccatactgaactggaatcctgtctacggtggttccaccgtagacaggattcgaaacaggcattggttgtgcg

SEQ ID NO: 18406 - RNA, 139 nt, unidentified
  source 1..139: mol_type = other RNA; note = Planctomycetes bacterium; note = Related to JABTUM010000004.1
gtcaagcgaacgagcgcaagctcgggccgcggggttaccccgcgggcgaagacacggcttggatccgtcgtatgagctagacgcgcgatgggcgcggacgcgccatcgcgcgctagctccacacaggtgctgttgattt

SEQ ID NO: 18407 - RNA, 139 nt, unidentified
  source 1..139: mol_type = other RNA; note = Related to JACQFI010000030.1; note = Planctomycetes bacterium
gtcaagcgaactcgcgcaagcgagggctgcggggttaccccgcaggcgaactaatggcttgcattcgtcggttgtctgtatcccgcgactcgggcagtgccgagtcgcgggtacagaccacacaggtcaaggttgatac

SEQ ID NO: 18408 - RNA, 137 nt, unidentified
  source 1..137: mol_type = other RNA; note = Planctomycetes bacterium; note = Related to JACKID010000003.1
gatttgactgcgcaggcttcgcgccttcgcgcggcggggttaccccgccggaacgcagtggtttctcatgcattgcccgaccaagccgaggtttctgcgaaacctcggcttggtcggggccgggagctggaagtctc

SEQ ID NO: 18409 - RNA, 123 nt, unidentified
  source 1..123: mol_type = other RNA; note = Planctomycetes bacterium; note = Related to JAGQRI010000064.1
gacttgactgcgaaagcaggggcggggctaccccgtccattcgccaagcttcttcatgcaacgctggggtaacacggtcttctacgaagaccgtgttaccccaggccgggagccggaagtctc

SEQ ID NO: 18410 - RNA, 137 nt, unidentified; identical to SEQ ID NO: 18408
  source 1..137: mol_type = other RNA; note = Related to JACKID010000003.1; note = Planctomycetes bacterium

SEQ ID NO: 18411 - RNA, 134 nt, unidentified
  source 1..134: mol_type = other RNA; note = Planctomycetes bacterium; note = Related to JAGQRE010000003.1
gatttgactgcgctgacttcggtcaacgcgcgaaggggctaccccttcgaaacgcagtggtttctcatgcatcgcacgacctgaccggttcattgcatgaaccggtcaggtcgtggccgggagctggaagtctc

SEQ ID NO: 18412 - RNA, 124 nt, unidentified
  source 1..124: mol_type = other RNA; note = Related to JADLAK010000089.1; note = Planctomycetes bacterium
gatttgccggccgcaaggccgagacggggttaccccgtcatcgcagccagctagaccatgcgacgtctggatcgcgacaactctgcgagttgtctgcgatccaggccgggagcaaggaaatcgg

SEQ ID NO: 18413 - RNA, 232 nt, unidentified
  source 1..232: mol_type = other RNA; note = Related to OCMT01000001.1; note = Pedobacter xixiisoli
ctttcggatttaaaaaataccttgctttttctgcataagaaaatgatgatgtttcgtcatcgaagaattgatatttgacacacggcactacctgcaatctttatggggagaacacgtactatacgtacggtttcggttccatactccgcgagtttaaccgtacgtatagtacgtgttctctggagttgattgatatagtcctatgaaaatacgaaggattttaaattctgcc

SEQ ID NO: 18414 - RNA, 232 nt, unidentified
  source 1..232: mol_type = other RNA; note = Related to NZ_CP042171.1; note = Pedobacter sp.
ccctcggattaaaaaaataccttgctttttctgaataagaaaatggtgatgtttcgtcatcgatgaactaatatttgacactcggcactacctgcaatctttatggggagaacacgtaccatacgtacggtttcggttccatactccgcgagtttaaccgtacgtatggtacgtgttctctggagttgattgatatagtcctatgaaaatacgaaggattttaaattcgggc

SEQ ID NO: 18415 - RNA, 232 nt, unidentified
  source 1..232: mol_type = other RNA; note = Related to NZ_SJCY01000003.1; note = Pedobacter changchengzhani
tggcaattaatttagtaaataccttgcttttctgaataagaaaatgatgatgtttcgtcatcgatgaataatatttgacacacggcactacctgcaatctttatggggagaacacgtactatacgtacggtttcggtaccgtactccaagagtttaaccgtacgtatagtacgtgttctctggagttgattgatatagtcctatgaaaatacgaaggttctaaattaaagcc

SEQ ID NO: 18416 - RNA, 217 nt, unidentified
  source 1..217: mol_type = other RNA; note = Related to QVMJ01000008.1; note = Bacteroides sp.
agttcggaaagtaccttgcttttctgaaaagaaaaagatgatgtttcgtcatcggtgaatagatatttgacattcggcactacctccaatctttatggggagatacactactatacgcatggttgctgttctcctctccacgagattaaccatgcgtatagtagtgtatctctggagttgattgatatagtcctgggaaaatacgaagattccgaac

SEQ ID NO: 18417 - RNA, 219 nt, unidentified
  source 1..219: mol_type = other RNA; note = Related to JAJQFD010000060.1; note = Bacteroides sp.
cggtttagaaataccttgcttttctgcaaagaaaaagatgatgtttcgtcatcgatgagcaattgtttgacattcggcactacctgcaatctttatggggaggatacctactatacgtatggtttgctgttcttccctccgcgaggtaaaccatacgtatagtaggtatcctctggagttgattgatatagtcccaggaaaatacgaaggttctgaacc

SEQ ID NO: 18418 - RNA, 229 nt, unidentified
  source 1..229: mol_type = other RNA; note = Related to NZ_CP034930.1; note = Apibacter raozihei
gttcagggttaaaaaataccttgcttttctgaataagaaaaagatgatgtatcgtcatcggtgagctattgctagacattcggcactacctgcaatctttatggggagagtaactactatacgtatggttacggttctcctctccacgagtttaaccatacgtatagtagttactctctggagttgattgatatagtccttagaaaatacgaaggttttttaacctgaa

SEQ ID NO: 18419 - RNA, 230 nt, Flavobacterium sp.
  source 1..230: mol_type = other RNA; note = Related to PRDM01000004.1
gttttgagtttaagaaataccttgcttttcttgtataaagaaaatgatgatgtttcgtcatcggtgtaaaaatatttgacattcagcactacttctatcttatggatgagaaagtgtactaggcgtacagtttcggttccacctcctcgagattaactgtacgcctagtacactttctctggagttgatagacatagtccttagagaatacgaaggttttaaactttaag

SEQ ID NO: 18420 - RNA, 231 nt, Flavobacterium sp.
  source 1..231: mol_type = other RNA; note = Related to NZ_QJHK01000001.1; note = Flavobacterium cheongpyeongense
gttttgagtttaagaaataccttgctttttcttgtataaagaaaatgatgatgtttcgtcatcgatgtaaaattatttcacattcagcactacttctatcttatggatgagaaagggtactatacgtacagtttcggttccacctccttgagattaactgtacgtatagtaccctttctcgggagttgatagacatagtcctcagaaaatacgaaggttttaaacttttaa

SEQ ID NO: 18421 - RNA, 230 nt, Flavobacterium sp.
  source 1..230: mol_type = other RNA; note = Related to NZ_JASY01000021.1; note = Flavobacterium chungangense
gttttgagtttaagaaataccttgcttttcttgtataaagaaaatgatgatgtttcgtcatcggcgtaagattatttaacattcagcactacttctatcttatggatgagaaaaggtactatgcgtacagtttcggttccacctcctcgagattaactgtacgcatagtaccttttctcgggagttgatagacatagtccttagaaaatacgaaggttttaaactttaag

SEQ ID NO: 18422 - RNA, 230 nt, Flavobacterium sp.
  source 1..230: mol_type = other RNA; note = Related to NZ_CP091285.1; note = Flavobacterium jumunjinense
tgttacaagtttaagaaaaaccttgcttttcttttttaaagaaaaagatgatgtttcgtcatcgaagtacaattatttgacattcagcactacttctatctattggatgagaaagggtactatacgtacagtttcggttccgcctccacgagattaactgtacgtatagtaccctttctctggagttgatagacatagtccttagaaaatacgaaggtttaaactttagc

SEQ ID NO: 18423 - RNA, 202 nt, unidentified
  source 1..202: mol_type = other RNA; note = Related to DQAM01000521.1; note = Dysgonomonas sp.
aggtttggaaaataccttgcttttctgaataagaaaaagatgatgtttcgtcatcggcggaaaaatatttgacattcggcactacctgcaatctttattgggagaatagctactatacgcatnnnnnnnnnnnnatgcgtatagtagctattctctggagttgattgatatagtcccaggaaaatacgaaggttcccgaacc

SEQ ID NO: 18424 - RNA, 227 nt, unidentified
  source 1..227: mol_type = other RNA; note = Related to JAFKHH010000015.1; note = Filimonas sp.
gtcacggatttggaaagtaccttgcttttctgaataagaaaatgatgatgtatcgtcatcactgattcattataagacattcggcactacctgcaatcttatggggagaacacgcactagtatgtgcggtttcggtacccgctccaagagttcaaccgcacatactagtgcagttctcggagttgattgatatagtccgcggaaaatacgaaggttccgatccaggc

SEQ ID NO: 18425 - RNA, 231 nt, unidentified
  source 1..231: mol_type = other RNA; note = Related to NZ_OEPV01000013.1; note = Dysgonomonas sp.
aagtagaggttaagaaaatacttgcttttctgaataagaaaaagatgatgtttcgtcatcaatgagcaatatttatcattcagcactacctgcaatcttttggtggagaattggtactatacgtaccattagcagttctcctctcgttgcgagttaatggtacgtatagtaccattctctggagttgattgttgtagtcccaagaaaatacgaagcatgcttaccctcaca

SEQ ID NO: 18426 - RNA, 211 nt, unidentified
  source 1..211: mol_type = other RNA; note = Related to JAKVIP010000001.1; note = Chryseobacterium sp.
tagatagatccttgcttttctttttaagaaatgatgatgtttcgtcatcgatggaaaattgcttagcatactgcactacatactatctttatggtgaaattggtactagtgcgtgccttttcagttcattttccgggaaaataaaggtacgcactagtacccatttctggagttgatagatatagtccttagaagatacgaaggtatatca

SEQ ID NO: 18427 - RNA, 212 nt, unidentified
  source 1..212: mol_type = other RNA; note = Related to NZ_FQUT01000024.1; note = Chryseobacterium arachidis
aagatagatccttgcttttctttttaaagaaatgatgatgtttcgtcatcactgtgaaattgcttagcatacgtcactacatactatcttgatggggaaaatggtactagtaggtaccttttcagttcattttccgagaaaataaaggtacccactagtaccattttctggagttgatagatatagtccttagaaaatacgaaggtttatcc

SEQ ID NO: 18428 - RNA, 213 nt, unidentified
  source 1..213: mol_type = other RNA; note = Related to NZ_FTOV01000003.1; note = Chryseobacterium gambrini
aagatagatccttgctttcttttttaagaaaagatgatgtttcgtcatcactgtaaaattgcttagcttacggcactacatactatctttaatggggaaaatggtactagtgggtaccttttcagttcattttccgggaaaataaaggtacccactagtaccattttctgggagttgatagatatagtccttggaaaatacgaaggtttatcc

SEQ ID NO: 18429 - RNA, 211 nt, unidentified
  source 1..211: mol_type = other RNA; note = Related to NZ_JPRO01000015.1; note = Chryseobacterium luteum
aagatagatccttgcttttctttttaagaaatgatgatgtttcgtcatcgatgtaaaattgcttagcatactgcactacatactatctttaatggtgaaattggtactagtgcgtgccttttcagttcattttccgggaaaataaaggtacgcactagtaccatttctggagttgatagatatagtcctcagaagatacgaaggtatatca

SEQ ID NO: 18430 - RNA, 213 nt, Flavobacterium sp.
  source 1..213: mol_type = other RNA; note = Related to NZ_PJQW01000010.1
agttaaataccttgcttttcttgtaaaagaaaaagatgatgtttcgtcatcaagtagaaattgtatttcacacatcactacatactatctttagggtgagaatacgcactagtagtgcattttcggttccttctccgagagataaaatgcactactagtgcgtattctctggagttgatagatatagtccttagaaaatacgaaggatttaac

SEQ ID NO: 18431 - RNA, 216 nt, Flavobacterium sp.
  source 1..216: mol_type = other RNA; note = Related to NZ_CP090145.1; note = Flavobacterium sediminilitoris
aggttaagtaccttgcttttcttttaaaaagaaaaagatgatgtttcgtcatcaagtagaaattgtatttcacacatcactacatactatctttagggtgagaaaacgtactagtagtgcattttcggtgccttctccgagagataaaatgcactactagtacgttttctctggagttgatagatatagtcctaagagaatacgaaggttttaact

SEQ ID NO: 18432 - RNA, 211 nt, unidentified
  source 1..211: mol_type = other RNA; note = Related to JAIBAX010000003.1; note = Chitinophagales bacterium
ttgacattaccttgcttttctgaataagaaatgatgatgtttcgtcatcggtgtaagattgtaaatcatactacactacctactatctttatggtgagaataggtactatacgtgccttttcagaccattttccatgaaattaaaggcacgtatagtacctattctctggagttgatagatgtagtcctaagaagatacgaaggcatgtca

SEQ ID NO: 18433 - RNA, 211 nt, Flavobacterium sp.
  source 1..211: mol_type = other RNA; note = Related to NC_016001.1; note = Flavobacterium branchiophilum
aagaataaccttgcttttctatttatagaaatgatgatgtatcgtcatcgttgcatgtttgtaagacatactacactacatactatctttatggtgagaaagagtactatacgtgcattttcaggccattttccgagaaaccaaatgcacgtatagtactctttctctggagttgatagatatagtccttagtaaatacgaaggttacgct

SEQ ID NO: 18434 - RNA, 231 nt, unidentified
  source 1..231: mol_type = other RNA; note = Tannerellaceae bacterium; note = Related to JAJQES010000108.1
gggaggtttggaaataccttgcttctttttcagagaaagatgatgtttcgtcatcgttgtgctaagagttcatcacctgccctgcccgcaatcaccagaccggagcacaatggtttctttagcacgttatacagttcctactccgcgagatcaaacgttctaaagaaaccattgtgctccggagttgattgggatagtcccgggaaaatacgaaggatccaaaccaaagcc

SEQ ID NO: 18435 - RNA, 232 nt, unidentified
  source 1..232: mol_type = other RNA; note = Related to LJIE01000001.1; note = bacterium 336/3
ccatagagatttgaaaataccttgcttcttagcaataagatgaacgatgtttcgtcgttcttgaaaatttgtaacaaatacttcactacatactatctttatggtgactacaccaccctatcgggtgtttcctgtgttaccaccaagtgcttaaacacccgatagggtggtgtagtcttggagttgatagatatagtccagagaaaatacgaagttctttcaaatcattatc

SEQ ID NO: 18436 - RNA, 234 nt, unidentified
  source 1..234: mol_type = other RNA; note = Related to NC_018018.1; note = Bernardetia litoralis
aatacagtagttataagtaccttgctttctaagtttattcttagaatgaatgatgtttcgtcattcaagaaattttacctagcatacatcactacatactatctttatgatgactaacaccacctatatgctatttacggtatgagtgcgctgcacttaaatagcatataggtagtgttagtctggagttgatagatatagtcctcagataatacgaagattttataattgtat

SEQ ID NO: 18437 - RNA, 233 nt, unidentified
  source 1..233: mol_type = other RNA; note = Related to NZ_AUMD01000019.1; note = Eisenibacter elegans
caagagcgttaaaaataccttgcgttcccgttagagggaaaggatgatgtttcgtcatccgcgcttcattactgcacatgcttcactacgtgctatctttatttggcagatagggggatagtgaagcttttacggacaattttgccgagcaaaataaaagctccactatccccctatctgtggagttgacagacctagtccggagagcatacgaagttatttttatcacgctg

SEQ ID NO: 18438 - RNA, 225 nt, unidentified
  source 1..225: mol_type = other RNA; note = Cytophagales bacterium; note = Related to RDZE01000015.1
taaaaggctgaaaatacttgctttccccttaaaaggaaaaaatgatgtttcgtcattgtcgcaaaaaaacaacacttacatcactacatactatcttaatttagaagaactactactatatgacatttacaggtcatattcccagaatataaatatcatatagtagtggttctttgtgagttgatagatatagttctgagaaaatacgaagtaattttgcctttt

SEQ ID NO: 18439 - RNA, 234 nt, unidentified
  source 1..234: mol_type = other RNA; note = Related to JAAAKT010000013.1; note = Emticicia sp.
acaaagtaagagtaaataagaccttgccttccgaaaggaaagaacgatgtatcgtcgttcatgaaatttgactctacatgcatcactaaatacaatcttcactgtgagagctttgtctggtagacaatatttaacagtgaaaactccgagagtttaaaatatcgtctaccagaccgctctcttggagttgattgatttagtcataagaatcttcgaaggttttactctactttg

SEQ ID NO: 18440 - RNA, 227 nt, unidentified
  source 1..227: mol_type = other RNA; note = Related to JAFMYU010000001.1; note = Fibrella aquatilis
tcgggttggggttgcaagaccttgcctttccttcgggaaatgaatgatgtttcgtcattctggtaccaagactacacacgcctcactacgtcaatcgttactgtgggggagggggtactagtgcaccttcacagtgcggctcctggggagttgaaggtgcactagtaccccctccccctggagttgattgacatagtcctgagtttgttcgaaggccttcccgcccg

SEQ ID NO: 18441 - RNA, 232 nt, unidentified
  source 1..232: mol_type = other RNA; note = Related to NC_020054.1; note = Fibrella aestuarina
gtgcggcgggcgtcaaaaccttgcctttccctcagggaaacgaatgatggttcgtcattccggtatcaagactacacacgcatcactacgtcaatcgttactgtggggagagggtactagtacgaccctcacagtgcgactcctgtggagttgagggtcgtactagtaccctctcccctggagttgattgacatagttctcagtttgttcgaaggctggcccggctgccgcc

SEQ ID NO: 18442 - RNA, 230 nt, unidentified
  source 1..230: mol_type = other RNA; note = Related to NZ_PVTE01000003.1; note = Spirosoma oryzae
acggtcaggcacgcaaaagaccttgcgtttccttcgggaaaagaacgatgtttcgtcgttcgtgccaactgacttcacacgcatcattacgtgcaatcgttactgtggggggcttcgtactaggggcaccttttcggtacgactcctgcggactaaaaggtgcccctagtacggccccccgggagtggattgacgtaatcctgagattgttcgaaggccgtgtctgactg

SEQ ID NO: 18443 - RNA, 229 nt, unidentified
  source 1..229: mol_type = other RNA; note = Related to JAGHZS010000007.1; note = Chitinophaga sp.
tgtaaagaggaattgattgcacttgcgcccgaaaagggacgaatgatgtttcgtcattcaggtttattgactatacatgcttcactaaatgcaatctttactttgggaggggcctaccatacgcatatttccggtagtagccccgagggctgaaatatacgtatggtaggcccctccctggagttgattgatttagtcaatggttcgcacgaaggcctttcctctttac

SEQ ID NO: 18444 - RNA, 230 nt, unidentified
  source 1..230: mol_type = other RNA; note = Related to NZ_JAGTXB010000010.1; note = Chitinophaga hostae
tgtaaagaggaattgattgcacttgcgcccgaaaagggacgaatgatgtttcgtcattcaggtattttgactatacatgcttcactaaatgcaatctttactttgggaggggcctaccatacgcatatttccggtagcagccccgggggctgaaataatgcgtatggtaggcccctccctggagttgattgatttagtcaatggttcgcacgaaggcctttcctctttac

SEQ ID NO: 18445 - RNA, 230 nt, unidentified
  source 1..230: mol_type = other RNA; note = Related to NZ_FOJG01000002.1; note = Chitinophaga arvensicola
tgtaaagaggaattgattgcacttgcgcccgaaaagggacgaatgatgtttcgtcattcaggtattctgactatacatgcttcactaaatgcaatctttactttgggaggggcctactatacgcatatttccggtagtagccccgagggctgaaatatgcgtatagtaggcccctccctggagttgattgatttagtcaatggtttgcacgaaggccttttcctctttac

SEQ ID NO: 18446 - RNA, 230 nt, unidentified
  source 1..230: mol_type = other RNA; note = Related to NZ_VIWO01000002.1; note = Chitinophaga polysaccharea
tgtaaagaggaattgattgcacttgcgcccgaaaagggacgaatgatgtttcgtcattcaggtattttgactatacatgcttcactaaatgcaatctttactttgggaggggcctaccatacgcatatttccggtagaagccccaggggctgaaatatacgtatggtaggcccctcccttgagttgattgatttagtcaatggcttgcacgaaggcctcttcctctttac

SEQ ID NO: 18447 - RNA, 233 nt, unidentified
  source 1..233: mol_type = other RNA; note = Related to NZ_FRBL01000014.1; note = Chitinophaga jiangningensis
tataaagaggaattgattgcacttgcgctccttcatggagatgaatgatgattcgtcattcaggtattttgactatacatgcttcactaaatgcaatctttactttgggaggggcctactatgtagatatttacggtaagagcccctggggcttaaatatccacatagtaggcccctccctggagttgattgatttagtcaatggtttgcacgaagcgccctttcctctttat

SEQ ID NO: 18448 - RNA, 234 nt, unidentified
  source 1..234: mol_type = other RNA; note = Related to NZ_QLMA01000005.1; note = Chitinophaga dinghuensis
tataaagaggaattgattgcacttgcgctccttcatggagatgaatgatgtttcgtcattcaggtattctgactatacatgcttcactaaatgcaatctttactttgggaggggcgtactatatcgatatttacggtataagccccttggggcttaaatatcaatatagtacgcccctccctggagttgattgatttagtcaatggtttgcacgaagcgccctttcctctttat

SEQ ID NO: 18449 - RNA, 232 nt, unidentified
  source 1..232: mol_type = other RNA; note = Related to VWWO01000002.1; note = Chitinophaga sp.
tataaagaggaattgattgcacttgcgctccttacggagatgaatgatgtttcgtcattcaggtatactgactatacatgcttcactaaatgcaatctttactttgggaggggcgtactagtatgatatttactgtacaagcccctggggctcaaatatcacactagtacgcccctccctggagttgattgatttagtcaatggcttgcacgaagcgcctgttcctctttat

SEQ ID NO: 18450 - RNA, 230 nt, unidentified
  source 1..230: mol_type = other RNA; note = Related to NZ_PYAW01000007.1; note = Chitinophaga niastensis
tgtaaagaggaattgattgcacttgcgcccgaaaagggatgaatgatgtttcgtcattcaggtatattgactatacatgcttcactaaatgcaatctttactttgggaggggcgtactatggtgatatttactgtacgcgccccgggggctgaaatatcaccatagtacgcccctccctggagttgattgatttagtcataggtttgcacgaaggccttttcctctttac

SEQ ID NO: 18451 - RNA, 231 nt, unidentified
  source 1..231: mol_type = other RNA; note = Related to NZ_CP051205.1; note = Chitinophaga oryzae
tgtaaagaggaattgattgcacttgcgcccgtaaaagggacgaatgatgtttcgtcattcaggaattatgactatacatgcttcactaaatgcaatctttactttgggaggggcgtacctagtgcgaatttacggtacgagccccgggggctgaaattcacactaggtacgcccctccctggagttgattgatttagtcaatggcttgcacgaaggccttttcctctttac

SEQ ID NO: 18452 - RNA, 231 nt, unidentified
  source 1..231: mol_type = other RNA; note = Related to NZ_QFFJ01000003.1; note = Chitinophaga flava
tgtaaagaggaattgattgcacttgcgcccgtaaaagggacgaatgatgtttcgtcattcaggtattttgactatacatgcttcactaaatgcaatctttactttgggaggggcgtacctagtgcgaatttacggtactagccccgggggctgaaattcacactaggtacgcccctccctggagttgattgatttagtcaatggcttgcacgaaggcctcttcctctttac

SEQ ID NO: 18453 - RNA, 231 nt, unidentified
  source 1..231: mol_type = other RNA; note = Related to NZ_RIAR02000001.1; note = Chitinophaga solisilvae
tgtaaagaggaattgattgcacttgcgcccgtaaaagggacgaatgatgtttcgtcattcaggtattttgactatacatgcttcactaaatgcaatctttactttgggaggggtgtacctagtgcgaattttcggtacgacccccgaggggtgaaattcacactaggtacacccctccctggagttgattgatttagtcaaaggtttgcacgaaggccttttcctctttac

SEQ ID NO: 18454 - RNA, 232 nt, unidentified
  source 1..232: mol_type = other RNA; note = Chitinophagaceae bacterium; note = Related to JACMJX010000348.1
ttgtaaggaggtttgattgcacttgcgcccgtaacagggaagagtgatgtttcgtcactcaggttaaatgactttacatgcttcactaaatgcaatctttactatgggatgggggtacctatgtagatttgacggtactccccccgggggggcaaaatctacataggtacccccatccctggagttgattgatttagtcaaaggtttgcacgaagggccattcctccttaca

SEQ ID NO: 18455 - RNA, 232 nt, unidentified
  source 1..232: mol_type = other RNA; note = Related to NZ_CP077769.1; note = Chitinophaga sp.
taaggaggaaaaatgattgcacttgcgcccttttatagggaagagtgatgtttcgtcactcaggtaacatgactatacatgcttcactaaatgcaatctttactttgggaggggcgtacctatgcacaatttacggttcacgcccccggggcgcaaattatgcataggtacgcccctccctggagttgattgatttagtcaatggctagcacgaaggccttttttcctcttt

SEQ ID NO: 18456 - RNA, 232 nt, unidentified
  source 1..232: mol_type = other RNA; note = Related to NZ_JAICCF010000004.1; note = Chitinophaga rhizophila
gtaaagaggaaattgattgcacttgcgcctggtttcaggaagagtgatgtttcgtcactcaggtaacatgactttatcatgcttcactaaatgcaatctttactttggacggggcgtacctactagtgatttacggtactagccccgggggctccaaatcaccagtaggtacgccccgtcctggagttgattgatttagtcaatggcttgcacgaaggccgtttcctcttta

SEQ ID NO: 18457 - RNA, 233 nt, unidentified
  source 1..233: mol_type = other RNA; note = Related to NZ_CP048113.1; note = Chitinophaga sp.
gtaaagaggaaattgattgcacttgcgcctggtttcaggaagagtgatgtttcgtcactcaggtaacatgacattatcatgcttcactaaatgcaatctttactttgggaggggcctacctagtagtgatttacggtacgagccccaggggctccaaatcaccactaggtaggcccctccctggagttgattgatttagtcaatggcttgcacgaaggccgatttcctcttta

SEQ ID NO: 18458 - RNA, 234 nt, unidentified
  source 1..234: mol_type = other RNA; note = Related to NZ_PYGK01000009.1; note = Chitinophaga ginsengisoli
ttgtaaagaggaaagtttgcacttgcgcctggtttcaggaagagtgatgtttcgtcactcaggtaacatgacattatcatgcttcactaaatgcaatctttactttgggcggggcgtacctaccagtaatttacggtacgagccccgggggctccaaattaccggtaggtacgccccgccctggagttgattgatttagtcaatggcttgcacgaaggctatttcctctttaca

SEQ ID NO: 18459 - RNA, 233 nt, unidentified
  source 1..233: mol_type = other RNA; note = Related to WRXN01000012.1; note = Chitinophaga tropicalis
tgtaaagaggaaatgattgcacttgcgcccgtaacagggaagagtgatgcttcgtcactcaggtaacatgactatacatgcttcactaaatgcaatctttactttgggcggggcacacctaccagtgatttacggtagaagccccgggggctataaatcaccggtaggtgtgccccgccctggagttgattgatttagtcaaaggcttgcacgaagggccgtttcctctttac

SEQ ID NO: 18460 - RNA, 232 nt, unidentified
  source 1..232: mol_type = other RNA; note = Related to NZ_QTJV01000007.1; note = Chitinophaga silvisoli
tataaagaggaaatgattgcacttgcgcccgtaaaagggacgaatgatgtttcgtcattcaggtaacatgactatacatgcttcactaaatgcaatctttactttgggaggggcgtactatagtgcaatttacagtactcgccccaggggccctaaattacactatagtacgcccctccctggagttgattgatttagtcaaaggcttgcacgaaggccatttcctctttat

SEQ ID NO: 18461 - RNA, 225 nt, unidentified
  source 1..225: mol_type = other RNA; note = Related to NZ_SEWF01000012.1; note = Emticicia agri
aaagtgagaagtactgaataccttgcattccgaaaggaaagaacgatgtatcgtcgttcatgacacaagacttcacacgcatcactaaatacaatctttactgtgaggggggctactataataccttttacagtaaaagctccgggagcttaaaaggtattatagtagcccccctcttggagttgattgatttagtctggagtaccatcgaaggttttctcactt

SEQ ID NO: 18462 - RNA, 230 nt, unidentified
  source 1..230: mol_type = other RNA; note = Related to QVMT01000016.1; note = Emticicia sp.
gcaaagtgagaagactaaagaccttgcattccgaaaggaaagaatgatgtttcgtcgttcatgaaacaagactttacacgcgtcactaaatacaatctttactgtgagggctatgtaccagtatgcattttacagtaaatgctccaggagcacaaaatgcacactggtacatgccctcttggagttgattgatttagtcctgagtatcttcgaaggtttttctcactttg

SEQ ID NO: 18463 - RNA, 231 nt, unidentified
  source 1..231: mol_type = other RNA; note = Related to NZ_QGGO01000002.1; note = Arcicella aurantiaca
gcaaagagaaaaacacaaagaccttgcattccgaaaggaaagaacgatgtttcgtcgttcgtgaaacatgactacacaagcatcactaattcaatctttactgtgagggcaagttaccagtacgcacttttacagtaaaatctccgagaaattaaaagtgcgtactggtaacgccctcttggagttgattgatttagtcctgagtatcttcgaaggtgttttttctctttg

SEQ ID NO: 18464 - RNA, 230 nt, unidentified
  source 1..230: mol_type = other RNA; note = Related to NZ_AUIF01000010.1; note = Runella zeae
gcaaatcaagaaattcaaaatcttgcattccgaaaggaaagaacgatgtttcgtcgttcgtgaaatatgactttacatgcgtcactaaatacaatctttactgtgagggctgcacccccatagggcttttacagtatggcttccttgaagcaaaagcccctatgggggtgcgccctcttggagttgattgatttagtcctgagtatgatcgaagaaaatttcttgaattt

SEQ ID NO: 18465 - RNA, 231 nt, unidentified
  source 1..231: mol_type = other RNA; note = Related to JAGIBF010000018.1; note = Niastella sp.
agagggaaaaagattatgcaccttgcttccgaaaggaaagggcgatgtttcgtcgtccatgcaacatgaactatacatgcatcaccaaatgtaatctttactatggcataccgggtgctatttgcttttagcagtacaggcccgttgtgccctaaaagcaaatagcacccggtatgccttgcgttgattaatctggtcaccggcgtgcacgaaggcagcatgatttccctc

SEQ ID NO: 18466 - RNA, 232 nt, unidentified
  source 1..232: mol_type = other RNA; note = Related to NZ_JAARML010000006.1; note = Paraflavitalea devenefica
acagagggaaaaaagatgcaccttgcttccgaaaggaaagggcgatgtttcgtcgtccatgcaacatgaactattcatgcatcaccaaatgtaatctttactatggcataccggctaccagtgcaatttatcagtactggcactgtgtgccttaaattgcactggtagccggtatgcctggcgttgattaatctggtcaccggcgcgcacgaaggcagcatgcttccctctg

SEQ ID NO: 18467 - RNA, 230 nt, unidentified
  source 1..230: mol_type = other RNA; note = Related to NZ_CP032157.1; note = Paraflavitalea soli
agagggaaaaaagatatgcaccttgcttccgaaaggaaagggcgatgtttcgtcgtccatgcaacatgaatatttcatgcatcaccaaatataatctttactatggcatacacactaccggtcaactatatcagtgccggcactgtgtgccatatagttcaccggtagtgtgtatgcctggcgttgattaatctggtcaccggcgagcacgaaggcagcattattccctc

SEQ ID NO: 18468 - RNA, 230 nt, unidentified
  source 1..230: mol_type = other RNA; note = Related to NZ_LVYD01000013.1; note = Niastella vici
agagggtaaaattacatgcaccttgcttccgaaaggaaagagcgatgtttcgtcgctcatgcaacatgaatatttcatgcatcaccaaatgtaatctttactatggcatataggtaccagtgtgcaattatcaggactggcactatgtgccttaattgcacactggtacccatatgccttgcgttgattaatctggtcactggtgtgcacgaaggcagcatgcttccctc

SEQ ID NO: 18469 - RNA, 231 nt, unidentified
  source 1..231: mol_type = other RNA; note = Related to NZ_LWBP01000254.1; note = Niastella populi
gaggggaaataattacatgcaccttgcttccgaaaggaaagagcgatgtttcgtcgctcatgcaacatgaatatttcatgcatcaccaaatgtaatctttactatggcatataggtaccagtgtactattttcagtaccggcactatgtgcctaaatagtacactggtacccatatgccttgcgttgattaatctggtcaccggtgtgcacgaaggcagcatgtttctcct

SEQ ID NO: 18470 - RNA, 233 nt, unidentified
  source 1..233: mol_type = other RNA; note = Related to JAKLTR010000008.1; note = Terrimonas sp.
tgacggggttgatgtatgcaccttgcttccgaaaggaaagaacgatgtttcgtcgttcatgcgacatgaatagttcatgcatcaccaaatgtaatctttactgtggcatacgggcctatatgtactggttaacagtacaggcaccgtgtgccaaaccagtacatataggcccgtatgcctggcgttgattaatctggtctcaggcacgcacgaaggaatacataaaccccgtc

SEQ ID NO: 18471 - RNA, 232 nt, Citrobacter sp.
  source 1..232: mol_type = other RNA; note = Related to QFQQ01000068.1; note = Citrobacter freundii
gacaggggtaatgcagcaccttgcttccgaaaggaaagaacgatgtttcgtcgttcatgcaacatgaatagttcatgcatcaccaaatataatctttactgtggcatacgggtactataccgctggttttcagttccaagccccgtgtgccaaaccagcggtatagtacccgtatgcctggcgttgattaatctggtctcgggcacgcacgaaggcagcacattatccccgt

SEQ ID NO: 18472 - RNA, 231 nt, unidentified
  source 1..231: mol_type = other RNA; note = Related to JAFLBL010000017.1; note = Chitinophagales bacterium
agagggtcgtttggcattgcaccttgcttcctgaaaaggaaagaacgatgtttcgtcgttcatgcaacatgactcgttcatgcatcaccaaatgtaatctttactatggcatacacgtaccagtgtacctttcccggtgcaggcacgtggtgccataatggtacactggtacgtgtatgcctggcgttgattaatttggtccgcggcaggcacgaaggcgcagccaccctc

SEQ ID NO: 18473 - RNA, 229 nt, unidentified
  source 1..229: mol_type = other RNA; note = Related to AP017422.1; note = Filimonas lacunae
gagatggtaaagtaaaggcaccttgcttccgaaaggaatgagcgatgtttcgtcgttctggttcaatgagtttctcatgcatcaccaaatgtaatctttactatggccggggggtaccgtatcaccattatcagtgatggccccgtgtgccataatagtgatacggtaccccccggcctggcgttgattaatctggtcccgggcgggcacgaaggcagccttaccatct

SEQ ID NO: 18474 - RNA, 231 nt, unidentified
  source 1..231: mol_type = other RNA; note = Related to NZ_BMIB01000004.1; note = Filimonas zeae
acagaaagatggtaatgcaccttgcttccgaaaggaaagagcgatgtttcgtcgttcaggtacaatgactttgtcatgcatcaccaaatataatctttactatggcccgggggtactatctcaccattatcggtgtaggccccttgtgccagaatagtgagatagtacccccgggcctggcgttgattaatctggtccccggcgtgcacgaaggcagctgccatctttctg

SEQ ID NO: 18475 - RNA, 205 nt, unidentified
  source 1..205: mol_type = other RNA; note = Related to NZ_VVIP01000043.1; note = Proposed Foetidibacter luteolus
atgcaccttgcttccgaaaggaaagagcgatgtttcgtcgctcatgcaaaatgagtttctcatgcatcaccaaatgtaatctttactatggccacagggtgctatatcactatttacagtgaaggccccgtgtgcctaaataatgatatagcaccctgtggcctggcgttgattaatctggtcccgggcaggcacgaaggcagca

SEQ ID NO: 18476 - RNA, 229 nt, unidentified
  source 1..229: mol_type = other RNA; note = Related to JAHBTJ010000009.1; note = Chitinophagaceae bacterium
acagagagatggcgttgcaccttgcttccgaaaggaaagaacgatgtttcgtcgttcatacagcatgactaatacatgcatcaccaaatgtaatctttactatggcctacacgtaccagtgtaccattttcggtaccggcactgtgtgccataatagtacactggtacgtgtaggccttgcgttgattaatctggtcagggcaggcacgaagggcggcgcctctctctg

SEQ ID NO: 18477 - RNA, 227 nt, unidentified
  source 1..227: mol_type = other RNA; note = Related to LUKG01000006.1; note = Flavihumibacter sp.
acagagagctggcgcagcaccttgcttccgaaaggaaagaacgatgtttcgtcgttcatacagcatgaccagtacatgcatcaccaaatgtgatctttactatggcatatatgtacctatgtactattttcagtacaggcactatgtgccataatagtacataggtacatatatgccttgcgttgatcaatctggtctgggcaggcacgaagggccgccgctctctg

SEQ ID NO: 18478 - RNA, 211 nt, unidentified
  source 1..211: mol_type = other RNA; note = Related to NZ_JACYFG010000060.1; note = Pelagicoccus enzymogenes
cgaaggcgatcctggctttgcaacccgagcggcgtatcgccgttcatgcacacagcctagcatcgcttcactggaacggtcgtcactgtgcgaacacgcataggtgtgtcgtttacagtgccgaccctgcgggtctaaacagacacacctatgcgtgttcgcttgagttgaccgcaccagtcataagagtacgcgaaagtcaggcgccttc

SEQ ID NO: 18479 - RNA, 222 nt, unidentified
  source 1..222: mol_type = other RNA; note = Verrucomicrobiae bacterium; note = Related to JAGROY010000010.1
cagtggcggggcgttgcaccttgcgatttgggcggcggatcgccgtccatgcccatagactagcaacgcaccactggcccgctcttgactgtgcgaggcatccgcccggtgtgcgcttttcggtgcagatccgggggatcaaaagcgcacaccgggcgggcctcgctggagttgaccgctccagtcctgagacctgcacgaaggcaataccgccccgccact

SEQ ID NO: 18480 - RNA, 221 nt, unidentified
  source 1..221: mol_type = other RNA; note = Related to NZ_CP025791.1; note = Flavivirga eckloniae
tggtagtgataagataaaaaccttgcattttgattggtggatcgccaatcttgcacacagataccgaacgcgtcactgactcgaacttaacttgtgaaataggtactagtgtactatttccggttagacttctgcgaagtgaaataatacactagtacctatttcactggagttgttcaattcagtcttgagaatcgtacgaaggcatacaaaatacatct

SEQ ID NO: 18481 - RNA, 222 nt, unidentified
  source 1..222: mol_type = other RNA; note = Related to SORL01000014.1; note = Algibacter lectus
tggtagtaataagataaaaaccttgcattttgattggtggatcgccaatcttgcttacagataccgaacgcgtcactgactcgaacttaacttgtgaaataggtaccatagtaccatttccggttagacttctacgaagtgaaatagtactatggtacctatttcactggagttgttcaattcagtcttgagaatcgtacgaagggcattcaaaatacatct

SEQ ID NO: 18482 - RNA, 212 nt, unidentified
  source 1..212: mol_type = other RNA; note = Related to NZ_LIQG01000027.1; note = Lacinutrix mariniflava
aagataaaaaccttgcattttgattggtgtatcgccaatcttgcttaaagacaccgaacgcgtcactgactcgaacttaacttgtgaaataggtactagtgtactatttccggttagacttctgcgaagtgaaataatacactagtacctatttcactggagttgttcaattcagtcttgagaatcgtacgaagggaattaaatagacatct

SEQ ID NO: 18483 - RNA, 220 nt, unidentified
  source 1..220: mol_type = other RNA; note = Related to NZ_VSDQ01000163.1; note = Seonamhaeicola marinus
cggtagtgataagataaaaaccttgcattttgattggtggatcgccaatcttgcacacagatactgaacgcatcactgactcgaacttaacttgtgaaataggtactatagtactatttccggttagacttctgcgaagtgaaataatactatagtacctatttcactggagttgttcaattcagtcttgagaatcgtacgaagggaacaaaatacatct

SEQ ID NO: 18484 - RNA, 222 nt, unidentified
  source 1..222: mol_type = other RNA; note = Related to WTCE01000070.1; note = Crocinitomix sp.
tggcagtaataagacaaaaaccttgcaattcggttggtggatcgccaatctagcatacagacaccgaacgcatcactgacctgaacttaacttatgaaatagacactagggtgctatttccggttatacttctacgaagtgaaatagcaccctagtgtctatttcattggagttgttcaattcagtctttagaaacgtacgaagggaactgaaaatacgtct

SEQ ID NO: 18485 - RNA, 213 nt, unidentified
  source 1..213: mol_type = other RNA; note = Related to NVRM01000058.1; note = Flavobacteriaceae bacterium
taagataaaaaccttgcaacgtgattggtgtatcgccaatcttgcttacagtttacgaatgcatcactgacttgaacttaacttgtgaaaagggtactatagtaccatttccggttatacttctccgaagtgaaatagtactatagtacccttttcactggagttgttaaattcagtctttggaatagtacgaagggaatttacataggtctt

SEQ ID NO: 18486 - RNA, 222 nt, unidentified
  source 1..222: mol_type = other RNA; note = Related to NZ_OENB01000038.1; note = Tenacibaculum dicentrarchi
tggtagtaataagataacgaccttgcaatttgattggtgtatcaccaatctagcttacagacaccgaacgcgtcactgactcgaacttaacttgtgaaataggtactatagtgccatttcctgttatacttcttcgaagtgaaatagcactatagtacctatttcactggagttgttcaattcagtctttagaattgtacgaagatatatcttattgctacc

SEQ ID NO: 18487 - RNA, 221 nt, unidentified
  source 1..221: mol_type = other RNA; note = Related to NZ_AUMF01000009.1; note = Tenacibaculum ovolyticum
tggtagtaataagataaaaaccttgcaatttgattggtgtatcgccaatctagcttacagacaccgaacgcgtcactgactcgaacttaacttgtgaaattagcactatagcactatttccggttatacttcttcgaagtgaaataatgctatagtgctaatttcactggagttgttcaattcagtctttagagttgtacgaagggaaaaaatatacatct

SEQ ID NO: 18488 - RNA, 221 nt, unidentified
  source 1..221: mol_type = other RNA; note = Related to NZ_CP053348.1; note = Winogradskyella forsetii
tggtagcaataagataaaaaccttgcattttgattggtggatcgccaatcttgtttacagacaatgaacgcgtcactgactcgaacttaacttgtgaaataggtaccatagtactgtttccggttagacttctacgaagtgaaacagtactatggtacctatttcactggagttgttcaattcagtctttagagtcgtacgaagggaattaaaatacatct

SEQ ID NO: 18489 - RNA, 215 nt, unidentified
  source 1..215: mol_type = other RNA; note = Related to NZ_CP009976.1; note = Cellulophaga baltica
aataagataaaaaccttgcattttgattggtggatcgccaatcttgtttacagacaatgaacgcgtcactgactcgaacttaacttgtgaaataggtactagtgtaccatttccggttagacttctatgaagtgaaatagtacactagtacctatttcactggagttgttcaattcagtctttagagtcgtacgaagggaaaaaatacatcttat

SEQ ID NO: 18490 - RNA, 215 nt, unidentified
  source 1..215: mol_type = other RNA; note = Related to BMWS01000013.1; note = Aquimarina muelleri
ataagagagaaaaccttgcattttgattggtggatcgccaatcctgcatacagacactaaacgcgtcactggctcgaacttaacttgtgaaataggtactatagtgccatttccggttagacttctacgaagtgaaatagcactatagtacctatttcactggagttgttcaatccagtctttagaattgtacgaagggaataaaatacatctta

SEQ ID NO: 18491 - RNA, 220 nt, unidentified
  source 1..220: mol_type = other RNA; note = Related to NZ_QMFY01000006.1; note = Chryseolinea flava
cggtagcagcaggatattaagacttgcaacccgggtggtggatcaccatccttgtacacagcttgctaacgcgccactggctcgttcttgactgtgcgatcctcgtactagtgtaccattcccggtgtgaaatctgaggaattgaaatagtacactagtacggtctcgcttgagttgaccgttccagtcctcaggatgacgaaggatatccgctgctacc

SEQ ID NO: 18492 - RNA, 217 nt, unidentified
  source 1..217: mol_type = other RNA; note = Related to JAIOAO010000004.1; note = Fulvivirgaceae bacterium QH1ED-6-2
gtagcagcaggatatcaaaaacttgcaatccgggtggtggatcaccatccttgtacacagcttactaacgcgccactggctcgttcctgactgtgcgatcctgcgaccatacgcacattttcggtgtgaaatctgaagaatttaaatgtgcgtatggtcgcgtctcgcttgagttgaccgttccagtcctcagcttgacgaagtatatccgctgcta

SEQ ID NO: 18493 - RNA, 217 nt, unidentified
  source 1..217: mol_type = other RNA; note = Related to JAERRB010000002.1; note = Chryseolinea sp.
gtagcagcaggatattaaaaccttgcaacccgggtggtggatcaccatccttgtacacagcttactaacgcgccactggctcgttcttaactgtgcgatcctgcaccagtacgcctatttccggtgtgaaatctggagaatttaaataggcgtactggtgcgtctcgcttgagttgaccgttccagtcctcagcatgacgaaggatatccgctgcta

SEQ ID NO: 18494 - RNA, 220 nt, unidentified
  source 1..220: mol_type = other RNA; note = Related to QFQN01000037.1; note = Azospira oryzae
tagcagcagagggtattatgacttgcaacccgggcggtggatcaccgtccttgtacacagcttactaacgcgccactggcccgttcttaactgtgcgatcctgccactaccccgtcattcccggtgcgaattctgggaattggaataacggggtagtggcgtctcgctggagttgaccgatccagtcctccgaaagacgaaggatatcctcgctgctact

SEQ ID NO: 18495 - RNA, 218 nt, unidentified
  source 1..218: mol_type = other RNA; note = Related to NZ_KE384560.1; note = Sporocytophaga myxococcoides
gtagtggcagggtattaaaatcttgcaacccgggctgtgtatcacagtccttgtacacagcttactaacgcgccaccggctcgttcttaactgtgcgatcctgccactatatgctcatttccggtgagaattccaggaattgaaataagcatatagtgacgtctcgctggagttgaccaatccggtcctcagaatgacgaagaatatcctgtacacta

SEQ ID NO: 18496 - RNA, 217 nt, unidentified
  source 1..217: mol_type = other RNA; note = Related to JAJTHV010000105.1; note = Flammeovirgaceae bacterium
tagcagacgagggtattaagacttgcaacccgggcggtgtatcaccgtccttgtacacagcttgctaacgcgccactggcccgttcttaactgtgcgatcctgcaacctacacactatttccggtgcgaattccgggaattgaaataatgtgtaggttgcgtctcgctggagttgaccgctccagtcctgagtatgacgaagtgtaccctcgctgct

SEQ ID NO: 18497 - RNA, 215 nt, unidentified
  source 1..215: mol_type = other RNA; note = Related to NZ_FUZU01000002.1; note = Ohtaekwangia koreensis
gtagcggaagggtataaaaaccttgcaatccgggcggtgtatcaccgtccctgtacacagcttactaacgcgccactggcccgttcttaactgtgcgatcctgctaccagtacgtcatttccggtgcgaattccgggaattgaaataacgtactggtagcgtctcgcttgagttgaccgatccagtcctcagcatgacgaaggtatcctccgcta

SEQ ID NO: 18498 - RNA, 215 nt, unidentified
  source 1..215: mol_type = other RNA; note = Related to NZ_JAFEWE010000006.1; note = Pedobacter sp.
tagtgaggcaggccgaaagaccttgcactccgggcggtggatcaccgtccttgcatacagcttagtaacgcgccaccggcctgttcttaactgtacgatcctggtaccatagtgatatttccggtgcaaatccggaggattgaaatatcactatggtaccgtctcgcttgagttgaccaatccggtcctcagaatgacgaaggtgcctcctcact

SEQ ID NO: 18499 - RNA, 220 nt, unidentified
  source 1..220: mol_type = other RNA; note = Related to JAJNDK010000004.1; note = Bacteroidetes bacterium
ttggaaggcgcaggcaaacatcttgcaacccgaacagtggatcgctgttcatgccaacagattagtaatgcatcactggtctgttctttactgtgcggtactgcatccagtacgccatttccggtgagacttcccggaagtgaaatagcgtactggatgcgtaccgcttgagttgaccaacccagtcctcaaagtgaacgaagaaagccctgcccttcca

SEQ ID NO: 18500 - RNA, 217 nt, unidentified
  source 1..217: mol_type = other RNA; note = Related to JAFDXR010000011.1; note = Bacteroidetes bacterium
tggaagaggcagtattacatcttgcaacccggttcgtgtatcgcgatccatgccaacagctcagtaacgcatcactggcctgttctttactttgcaatactgcacctactgtatcatttccggtgagacttcccggaagtgaaataatacagtaggtgcgtattgcttgagttgaccaatccagtcctcaagtagtacgaagaaaactgcctcttcc

SEQ ID NO: 18501 - RNA, 218 nt, unidentified
  source 1..218: mol_type = other RNA; note = Related to CP004371.1; note = Flammeovirgaceae bacterium 311
aggcagcagcaggagaaaaacttgcaatctgagcggcggatcgccgctccggcatacagcaatgcaacgcgtcactggcgcgttcttaacggtgcaccccatctatatgtatgccatttccggtgccacatcggagatgtgaaatagcatacatatagcggggtgcttgagttgaacactccagtcctgtgagtgtacgaagtagacctgctgctgct

SEQ ID NO: 18502 - RNA, 192 nt, unidentified
  source 1..192: mol_type = other RNA; note = Candidatus Moduliflexus flocculans; note = Related to DF820455.1
gaaacgcgacccgaacgaatatttgccttcaaaaacaccgcttcccagcttcactggcctgttcgcgactgtgcagagctaacgcctatctgcatttccggcgcaacttcccggaagtgaaattgcagataggcgttgctctgcttgagttgaacagtccagtcctgaggatgttcgaaggatttcgcgatt

SEQ ID NO: 18503 - RNA, 221 nt, unidentified
  source 1..221: mol_type = other RNA; note = Related to PDSK01000128.1; note = candidate division KSB3 bacterium
ttagagcggtgggggacattcttgcagatgggcgatggatcatcgtccgagcgcatagactgcccatgcttcactggtccgttcgtaactgtgcggagccttcgcctactgtgtcatttccggtgcgacatcggagatgtgaaataacacagtaggcgagctccgcgtgagttgaacgatccagtcctgagagatgtacgaagttctcctctgccgttcta

SEQ ID NO: 18504 - RNA, 220 nt, unidentified
  source 1..220: mol_type = other RNA; note = Related to NZ_BEXT01000001.1; note = Desulfonema ishimotonii
cgacagcggcagggccgtaccttgcattttgggcggcggatcgccgtccgcgcacacagactcgcaacgcaccaccggcccgttcataacggtgcgggacatgcctaccggggcccatttccggtttgacatcggagatgtgaaatagggccccggtaggcgtcccgcttgagttgaacggtccggtcgtcagcctgtacgaaggcgctctgccgctgtc

SEQ ID NO: 18505 - RNA, 222 nt, unidentified
  source 1..222: mol_type = other RNA; note = Related to NZ_JHZA01000001.1; note = Enterovibrio calviensis
tggtagcgcgacgttagaaccttgcatcgcgaatggtggatcaccattctggtacaaagactacccacgcgtcactgaggcaatcttaactgggccgtactgtcacctatatcgctattgcggtatgacttcgaagaagtcaatgagcgatataggtaacgtacggcatcgagttgattccctcagtactaagaactcttcgaaggaagttgtcgcgctacc

SEQ ID NO: 18506 - RNA, 222 nt, unidentified; identical to SEQ ID NO: 18505
  source 1..222: mol_type = other RNA; note = Related to NZ_SCHN01000009.1; note = Enterovibrio sp.

SEQ ID NO: 18507 - RNA, 222 nt, unidentified
  source 1..222: mol_type = other RNA; note = Related to NZ_JMIB01000006.1; note = Photobacterium galatheae
tggtagcgcggcaaaagaaccttgcatcgcgaatggtggatcaccattctggtttaaaggctgcccacgcgtcactggcgcaatcttaactgggccgcacagtcacctatatcgctattgcggtatgacttcgccgaagtcaatcagcgacataggtaacgtgcggcatcgagttgattccgccagtactgagaactcttcgaaggaagtggccgcgctacc

SEQ ID NO: 18508 - RNA, 222 nt, unidentified
  source 1..222: mol_type = other RNA; note = Related to NZ_CP073578.1; note = Photobacterium sp.
tggcagcgcggctccggaaccttgcatcgcgaatggtggatcgccattctggtggaaagactacccacgcgtcactggcccaatcttaactgggccgcacagtcacctatatcgctattgcggtttgacttcgcagaagtcaacgagcgacataggtaacgtgcggcatcgagttgattgcaccagtactgagaactcttcgaaggaagcggctgcgctgcc

SEQ ID NO: 18509 - RNA, 224 nt, unidentified
  source 1..224: mol_type = other RNA; note = Related to BMYC01000011.1; note = Photobacterium aphoticum
acggtagcgcggctaaagaaccttgcatcgcgaatggtggatcaccattctggtttacaggctacccacgcgtcactggtgaaatcttaactgggccgcacagtcacccatatcgctattgcggtatgacttcaaagaagtcaatgagcgatatgggtaacgtgcggcatcgagttgattaccccagtactcagaactcttcgaaggaagacgccgcgctaccg

SEQ ID NO: 18510 - RNA, 221 nt, Vibrio sp.
  source 1..221: mol_type = other RNA; note = Related to PIZL01000001.1
gcagcgcggcagaagaaccttgcctctcgaatggtggatcaccattcaggtataaagactgcccacgcatcactgatgctatctttactgagccgtacagtcacctataccgctattgcggtgtgacttcacagaagtcaatgagcggtataggtaacgtacggcatcgagttgataacctcagtactaagaactcttcgaaggaatatcttgtcgcgctg

SEQ ID NO: 18511 - RNA, 221 nt, Vibrio sp.
  source 1..221: mol_type = other RNA; note = Related to CAOA01000064.1; note = Vibrio nigripulchritudo
gcagcgcggcagaagaaccttgcatctcgaatggtggatcgccattcaggtttaaagactgcccacgcatcactgatgctatctttactgagccgtacagtcacctataccgctattgcggtgtgacttcacagaagtcaatgagcggtataggtaacgtacggcatcgagttgataccctcagtactaagaactcttcgaaggaatatcgcgtcgcgctg

SEQ ID NO: 18512 - RNA, 221 nt, unidentified
  source 1..221: mol_type = other RNA; note = Related to NZ_JAIMJA010000004.1; note = Motilimonas cestriensis
gcaacgcggttgtagaaccttgcatctcgaatggtgtttcgccattctggcacaaagactacccacgcgtagctaatgcaatcttaactgggccgtacagccccctatatcactattgcagtatggcttcaaagaagccaatgagtgatatagggggcgtacggcatcgagttgattgccttagcactgagaactcttcgaaggaaactttcaccgcgttg

SEQ ID NO: 18513 - RNA, 221 nt, Citrobacter sp.
  source 1..221: mol_type = other RNA; note = Related to NZ_CP057483.1
gcggcgtggcaagcgaaccttgcatcccggatggtggatcgccattcaggttttatgactgcccacgcgtcactgatgccatcttcactgggcagagtgtgagtacctgtcactattgcggtatggtttcgaagaaaccaatgagtgacaggtactccactctgcgtcgagtggacgacctcagcaccaggaactcttcgaaggctttttccgccacgccg

SEQ ID NO: 18514 - RNA, 221 nt, Citrobacter sp.
  source 1..221: mol_type = other RNA; note = Related to NZ_CP011132.1; note = Citrobacter amalonaticus
gcggcgtggcaagcaaaccttgcatcccggatggtggatcgccattcaggttttatgactgcccacgcgtcactgatgtcatcttcactgggcagagtgtgagtacctgtcactattgcagtatggcttcaacgaagccaatgagtgacaggtactccactctgcgtcgagtggataacctcagtaccaggaactcttcgaaggccttatccgccacgccg

SEQ ID NO: 18515 - RNA, 221 nt, unidentified
  source 1..221: mol_type = other RNA; note = Related to NZ_HE578945.1; note = Phytobacter massiliensis
gcggcgtggcagtggaaccttgcatcccggatggtggatcgccattcaggttttatgactgcccacgcgtcactgatgccatcttcactgggcagagtgtgagtacctgtcactattgcagtatggcttcaacgaagccaatgagtgacaggtactccactctgcgtcgagtggacgacctcagtaccaggaactcttcgaaggccttatccgccacgccg

SEQ ID NO: 18516 - RNA, 221 nt, unidentified
  source 1..221: mol_type = other RNA; note = Related to NZ_CP051548.1; note = Phytobacter diazotrophicus
gcggcgtggcaaggaaaccttgcatcccggatggtggatcgccattcaggttttatgactgcccacgcgtcactgatgccatcttcactgggcagagtgtgagtacctgtcactattgcagtatggcttcaacgaagccaatgagtgacaggtactccactctgcgtcgagtggataacctcagtaccaggaacgcttcgaaggccttattcgccacgccg

SEQ ID NO: 18517 - RNA, 221 nt, unidentified
  source 1..221: mol_type = other RNA; note = Related to NC_007645.1; note = Hahella chejuensis
gtagcgcgacaaaactaccttgcaatccgagcggtggatcgccgttcttgcttttagacttatcacgcttcactggccagatctttactgggccgtactgcaccacctatcgctattgcggtttggtttctacgaaaccaatgagcgataggtggtgcgtacggcgtcgagttgatcagtccagttctgagaattctacgaagggaaaccatgtcgcgcta

SEQ ID NO: 18518 - RNA, 221 nt, unidentified
  source 1..221: mol_type = other RNA; note = Related to NZ_CP020038.1; note = Agarilytica rhodophyticola
gcagtgcagcaggcctaccttgcaatgcgggcggtggatcgccgtccttgcttatagcctgttcacgcatcactggctcgatctttataatgccgcactgccactactatcgcttttgcggtatggcttctatgaagccaaagagcgatagtagtggcgtgcggcgtcgagttgatcgatccagttctgagaatcctacgaaggaaactcctgctgcactg

SEQ ID NO: 18519 - RNA, 221 nt, unidentified
  source 1..221: mol_type = other RNA; note = Related to NZ_ML660163.1; note = Aliikangiella coralliicola
gtaacgctgaccaacgaccttgcaatctgaatggtggatcgccattcttgcttaaagcctgctcacgcgtcactggtccgctctttactgggcgaggaatgcactaccacgtgcgtttctgtttggctcccctggagcaaacagcacgtggtagtgcatcctcgcgtcgagttgagcggcccagtcctgagaatacttcgaagggaaattcggtcgcgtta

SEQ ID NO: 18520 - RNA, 220 nt, unidentified
  source 1..220: mol_type = other RNA; note = Pseudomonadales bacterium; note = Related to JALJPK010000085.1
gtggcgctgatcaacaaccttgcaatccgaatggtggatcgccattcttgtttacagcctactcacgcatcactagtctgatctttactgggcgtaatagtgcccccataaacgtttcagtttggctccgcaggagcaaactgtttatgggggcactattacgcatcgagctgatcagaccagtcccgagaattctacgaagggaaattcgatcgcgtca

SEQ ID NO: 18521 - RNA, 222 nt, unidentified
  source 1..222: mol_type = other RNA; note = Related to NZ_CP048878.1; note = Spartinivicinus ruber
gtagtgtagtagagcaactaccttgcgttatgagcggtggatcgccgttcttacttaatgacagcccacgcatcactggcttgctcttaactgggccgaacatacactactatcactattgcggtatggcttccctgaagcgaatgagtgatagtagtgcagttcggcgtcgagttgagcaatccagtcttcaggattctacgaaggctgctcgctgcgcta

SEQ ID NO: 18522 - RNA, 221 nt, unidentified
  source 1..221: mol_type = other RNA; note = Related to NZ_SUNB01000001.1; note = Pleionea sediminis
ttggaaagcgtgaagaactttgcatctcggttggtggatcgccaacctggcttcaagacctctcatgcttcactgaccagctctttactgggcggaagatgccctactatcgctattgcagtatgacttcggtgaagtcaatgagcgatagtagggcacttccgcgtcgagttgagcagttcagttctaagaactctacgaaagcactattgcgctttcca

SEQ ID NO: 18523 - RNA, 212 nt, unidentified
  source 1..212: mol_type = other RNA; note = Related to CP059265.1; note = Candidatus Thiothrix singaporensis
aacaagtaaatgaaccttgcattttgaatagtggatcgctattcacgcatagagcctcgcaaagcatcatcagcttgctctttactaaggcggggactgcctactagtgcgaattgcattgggtttctaggaaaccaatatcgcactagtaggcgtccccgcatcgagtgtagcaagctgatcttctgcctgaacgaaggtcatttacctgt

SEQ ID NO: 18524 - RNA, 208 nt, unidentified
  source 1..208: mol_type = other RNA; note = Related to NZ_FNQP01000009.1; note = Thiothrix caldifontis
acagtaaatgaacccttgcctattgaacagtggatcgctgttcacgcaaaaagcctgtcaaagcgacatcagcttgctctttactagggcggggactgacgggtagtgcgaattgcattgcgtttctaggaaaccaatatcgcactacccgtcgtccccgcatcgagtgtagcaagctgatcttctggatgaacgaaggtatttactg

SEQ ID NO: 18525 - RNA, 216 nt, unidentified
  source 1..216: mol_type = other RNA; note = Related to SSFA01000023.1; note = Thiothrix sp.
ataacacgtaaatgaactttgcaatccgaatagtggatcgctattcctacacacagcctagcaaagcctcattaacttgctctttactaaagctcgggctcgctaccatcacgttttgcatagcgtttctaggaaaccaacaacgtgatggtagcggcccgagcatcgagtgtagcaagctaattttctgaatgaacgactgtcatttacgttata

SEQ ID NO: 18526 - RNA, 219 nt, unidentified
  source 1..219: mol_type = other RNA; note = Methylococcaceae bacterium; note = Related to JAKIVF010000151.1
ttagattaagcaaatgagccttgcaacccgaatagtggatcgctattcatgcatacagcctagcaacgcgtcattaacttgctctttactaaagcgggatcgcactactagtacgcattactatttcgtttcttggaaactaataagcgtactagtagtggatcccgcatcgagtgtagcaagctaattgtttgattgagcgaaggtatttgcttactg

SEQ ID NO: 18527 - RNA, 206 nt, unidentified
  source 1..206: mol_type = other RNA; note = Aquificaceae bacterium; note = Related to QOAQ01000092.1
aagcaaatgagccttgcaacccgaatagtggatcgctattcatgcacatagcctagcaacgcatcattaacttgctctttactaaagcgctatctcgctatctatacgcattacgatttgatttctaggaaattaatagcgtatagatagcggatagcgcatcgagtgtagcaagctaattgtttgattgagcgaaggtatttgct

SEQ ID NO: 18528 - RNA, 219 nt, unidentified
  source 1..219: mol_type = other RNA; note = Related to JADMKE010000002.1; note = Candidatus Sericytochromatia bacterium
tgctagggcacaagccggaaccttgcattatgaatcgtggatcgcgattcttgtccacagtgtggccatgcatcatgtacttgctcttcactatagcggccctgccctaccagagtgcatgtacgggatcctttcagggaaagtacatgcacctggtagggcgttccgcatcgagtgtaacaagcacattgtttgatagaacgaaggattgtgcctggc

SEQ ID NO: 18529 - RNA, 244 nt, unidentified
  source 1..244: mol_type = other RNA; note = Related to CP002831.1; note = Saprospira grandis
aggatcaagagaagacaaagtcttgcaaaaagagcgctgtttcggcgttcaagcgatattactcttcactgttcactaaggaagaatctttatgatgcgaaccgtggtaggtgcccctacttgttcccctacgcggtttcgagtcgtagactctgtaggggaacaagtaggggcacctaccacggttcgctggagttgattctcttagttctaagattgtacgaagtaaatcttctctccttct

SEQ ID NO: 18530 - RNA, 238 nt, unidentified
  source 1..238: mol_type = other RNA; note = Related to JABWAJ010000099.1; note = Saprospiraceae bacterium
gcggcggttgctgacaaaaaccttgcaatccggatgctgtttcggcatccatgacacaagaccaggcattcgccggcaaatcgaatcttcatgttgcagccttcggcctacccgggtatctattgcgatcccccggtgttgcgtcgaagacgcggttctcgcaatagatacccgggtaggccgggccgcgggagttgattcgcttgccacgctgatcgtacgaaggtcggcaccgccg

SEQ ID NO: 18531 - RNA, 220 nt, unidentified
  source 1..220: mol_type = other RNA; note = Related to CACVAP010000086.1; note = Sulfurovum sp.
ctagaaagtatgagagaaccttgcaatctgcatagtgtatcgctatgtttgtatagagtctagcaaagcgttattaacctattctttactattacaaataacactactatatgcatatttcgtagtggttttgtaaaaacaaatagtgcatatagtagtgctatttgtgtcgagttgaacaggctaatatttgaacgaacgaagactctcatacttttta

SEQ ID NO: 18532 - RNA, 220 nt, unidentified
  source 1..220: mol_type = other RNA; note = Related to CACVAX010000056.1; note = Sulfurovum sp.
tagaaacataagagaaccttgcaatttgcatggtgtatcaccatgtctgtttagagtctagcaaagcgttattagcatattctttactattacaaatagggtactagtgtacatatttcgtagtagtcttgtaaagacaaatagtgtacactagtaccccatttgtgtcgagttgaatacactaatatttgagtgaacgaagataaactcttttgtttca

SEQ ID NO: 18533 - RNA, 219 nt, unidentified
  source 1..219: mol_type = other RNA; note = Related to DQOI01000098.1; note = Campylobacterales bacterium
ctagaaagtataagagaaccttgcaatccgtatggtgtatcgccatatatgtatagagtctaacaaagcgttattaacacattctttactattacaaatagggtactagtgtatagattcgaagtggtcttgtaaagtcaaatcgtctacactagtaccccatttgtgtcgagttgaatgagctaatatttgaacgaacgaagactcttatacttttta

SEQ ID NO: 18534 - RNA, 222 nt, unidentified
  source 1..222: mol_type = other RNA; note = Related to NZ_QGKL01000042.1; note = Leucothrix arctica
aatgtgatgtgggcaaagaaccttgcaatccgggtggcgtatcgccatccacgcttatagctttgccatgcttcactggtgcattcttaactgggcacccctcactacccatacgcaattacggtataaggtcgttgaccttaatctgcgtatgggtagtgggggtgcttcgagttgaatgccccagtcccgtgtatcgaacgaaggatgcccacatcacat

SEQ ID NO: 18535 - RNA, 223 nt, unidentified
  source 1..223: mol_type = other RNA; note = Proteobacteria bacterium; note = Related to PDPH01000009.1
attgtgatgcgggcactgaaccttgcaaattgtttggtgtatcgccaagcttgcttaaagcaattgtatgcatcactgcctcgctcttgactgggccgaacggtctactgctagtgtcttacgctttaaagccgctggctttaagtacactagcagtagacgttcggcttcgagttgagcgatgcagtcccgagttaatgaacgaaggtcgctcgcatcacag

SEQ ID NO: 18536 - RNA, 230 nt, unidentified
  source 1..230: mol_type = other RNA; note = Related to PTEU01000001.1; note = Ideonella sp.
cgagtgcagcgcgtaggctcttgcaatccgggcggtgtttcgccgcccttgttcactgccgttctatgcgccacgggtgccgtcttcactgtgccgggctgccacccatcgcgcaatgtcaatggggctcgcttcgagcacattggcgcgatgggtggcgcccggcgtcgagtggacagcccccgtccctcaagcctttcaggctcttcgacgagaaacgcgctgcactc

SEQ ID NO: 18537 - RNA, 230 nt, unidentified
  source 1..230: mol_type = other RNA; note = Related to NZ_JAGQDG010000004.1; note = Ideonella paludis
cgagtgcagtgcgctggctcttgcaacccgggcggtgtttcgccgcccttgttcaccgccgttctatgcgccacgggtgccgtcttcactgtgccgggctgccacccatcgcgcaatgccaatcgggctcgcttcgagcacattggcgcgatgggtggcgcccggcgtcgagtggacagcccccgtccctcaagcctttcaggctcttcgacgagaagcgcactgcactc

SEQ ID NO: 18538 - RNA, 230 nt, unidentified
  source 1..230: mol_type = other RNA; note = Related to NZ_QUSW01000004.1; note = Proposed Albitalea terrae
cgagtgcagcgcgttggctcttgcaatccgggcggtgtttcgccgcccttgttgactgccgttctacgcgccacgggtgccgtcttcactgtgccgggctgccacccatcgcgcaatgccgatgtggctcgcttcgagcgcattggcgcgatgggtggcgcccggcgtcgagtggacagcccccgtccctcaagcctttcaggctcttcgatgagaagcgcgctgcactc

SEQ ID NO: 18539 - RNA, 230 nt, unidentified
  source 1..230: mol_type = other RNA; note = Related to RXJW01000018.1; note = Burkholderiales bacterium
cgggtgcagtgcgtgggctcttgcaatccgggcggtgtttcgccgcccttgtgaactgccgttctacgcaccacgggagctgtcttcactgtgccgggctgccacccgtcgcgccatgccgatggggttcgctccgaacgcatgagcgcgacgggtggcgcccggcgtcgagtggacagctcccgtccttcaagccttgcaggctcttcgatgaggagcgcactgcaccc

SEQ ID NO: 18540 - RNA, 230 nt, unidentified
  source 1..230: mol_type = other RNA; note = Related to SCTF01000217.1; note = Aquabacterium sp.
cgagtgcagcgcgcaggctcttgcaacccgggcggtgcttcgccgcccttgctgactgccgttccatgcgccacgggcgccgtcttcactgtgccgcgctgccacccagcgcgcgatgccgatgtgactcccatggagtgcatcggcgcgctgggtggcgcgcggcgtcgagtggacagcgcccgtcctccaagcctttcaggctcttcgacgagaagcgcgctgcactc

SEQ ID NO: 18541 - RNA, 229 nt, unidentified
  source 1..229: mol_type = other RNA; note = Related to VOBQ01000016.1; note = Caenimonas sp.
cgagtgcggtgcgcaggctcttgcaacccgggcgatgtttcgtcgcccatgcagcttgcctttccatgcatcacgggtgccgtcttcactgtggcgcacaccctccggtgcgcaatgccggtgtggcttccgaaaagcacattggcgcaccggagagcgtgcgccgtcgagtggacagcccccgtgccacaagccctgcgggctcttcgacgagaagcgcaccgcactc

SEQ ID NO: 18542 - RNA, 230 nt, unidentified
  source 1..230: mol_type = other RNA; note = Related to CP015118.1; note = Rhizobacter gummiphilus
cgagtgcggtgcgctggctcttgcaacccggacggtgtttcgccgtccttgcccactgccgttccatgcgccacgggcgccgtcttcactgtgccgcactgacacatggtgcgcaatgccgatgtggctccccgggagcgcattggcgcaccatgtgtcgtgcggcgtcgagtggacgtcccccgtcccgggagccttccaggctcttcgacgagaagcgcgccgcactc

SEQ ID NO: 18543 - RNA, 230 nt, unidentified
  source 1..230: mol_type = other RNA; note = Related to JACHYU010000002.1; note = Mitsuaria sp.
cgagtgcagcgcgcaggctcttgcaacccggacggtgtttcgccgtccttgcctcctgccgttccatgcgtcacgggcgccgtcttcactgtgccgcgcagcaccaccgtcgcagattcccatggggcttccctgaagcgaatcgtgcgacggtggtgcgcgcggcgtcgagtggacagcgcccgtccctcaagccttccaggctcttcgacgagaagcgcgctgcactc

SEQ ID NO: 18544 - RNA, 230 nt, unidentified
  source 1..230: mol_type = other RNA; note = Related to NZ_JACHXO010000001.1; note = Roseateles terrae
tgagtgcagcgcgcaggctcttgcaatccgggcggtgtttcgccgtctttgctccctgccgttccatgcgtcacgggcgccgtcttcactgtgccacccagccccaccatgggcatctccgatatggctcccctggagcaatatggcccatggtggggcgggtggcgtcgagtggacagcgcccgtccttcaagcctttcaggctcttcgacgagaagcgcgctgcactc

SEQ ID NO: 18545 - RNA, 232 nt, unidentified
  source 1..232: mol_type = other RNA; note = Related to LMDI01000056.1; note = Rhizobacter sp.
gtgagtgcagcacgtaggctcttgcaacccgggcggtgtttcgccgtccttgctccctgctgttccacgcgtcacgggcgccgtcttcactgtgccgcgctgacacccagtgcgcaatgccggtatggcttgcctcaagcgcattggcgcactgggtgtcgcgcggcgtcgagtggactgcgcccgtcctcgaagcctttcaggctcttcgatgagacacgtgctgcactca

SEQ ID NO: 18546 - RNA, 230 nt, unidentified
  source 1..230: mol_type = other RNA; note = Related to NZ_JAJNKD010000004.1; note = Ideonella azotifigens
cgggtgcagcgcgttggctcttgcaatccgggcgatgtttcgtcgcccttgccaaccgcctgttcatgcgtcacgggtgccgtcttcactgtgccgcgctcgcgccctgtgcgcaattgcggttgggcttgtctcaagccaattggcgcacagggcgcggcgcggcgtcgagtggacagcctccgtcctcggagccccctgggctcttcgatgagaaacgcgctgcaccc

SEQ ID NO: 18547 - RNA, 230 nt, unidentified
  source 1..230: mol_type = other RNA; note = Related to NZ_CP049905.1; note = Diaphorobacter sp.
ccggagcaatgagcaggctcttgcaatccgggcggtgtttcgccgcccttgtgaactgccgtttcatgcaccacgggcgccgttttcactgtgccaccccagccacggtagtgcttttcctgagtggcttgccacaagcgaagcagcactaccgtggcggggtggcgtcgagcgaacagctcccgtcccgtgagccctacaggctcttcgacgagatgcacattgctccg

SEQ ID NO: 18548 - RNA, 230 nt, unidentified
  source 1..230: mol_type = other RNA; note = Related to NZ_CP049910.1; note = Diaphorobacter sp.
ccggagcaacgcgcaggctcttgcaatccgggcggtgtatcgccgcccttgtgaactgccgtttcatgcaccacgggcgccgttttcactgtgccaccccagcgacggtagtgcatttcctgagtggcttgccacaagcgaaactgcactaccgtcgcggggtggcgtcgagcgaacagctcccgtcccgtgagccttacaggctcttcgacgagatgcacgttgctccg

SEQ ID NO: 18549 - RNA, 219 nt, unidentified
  source 1..219: mol_type = other RNA; note = Related to NZ_CP060783.1; note = Diaphorobacter aerolatus
tcaacgcgcaggctcttgcaatccgggtggtgtttcgccgcccatgtgaactgccgtttcatgcatcacgggcgccgttttcactgtgccaccccagccacggtagtgcatttcctgagtggcttgctacaagcgaagctgcactaccgtggcggggtggcgtcgagcgaacagctcccgtccgtgagcctttcaggctcttcgacgagaagcgcgctg

SEQ ID NO: 18550 - RNA, 230 nt, unidentified
  source 1..230: mol_type = other RNA; note = Related to NZ_CP060714.1; note = Diaphorobacter sp.
tcggagcaacgcgcaggctcttgcaatccggacggtgcttcgccgtccatgtgaactgccgtttcatgcaccacgggcgccgttttcactgtgccaccccagccatggtgtcgcgcttcctgagtggcttgccacaagcgaagcagcgacaccatggcggggtggcgtcgagcgaacagctcccgtcccgtgagcccgacgggctcttcgacgagaagcgcgttgctccg

SEQ ID NO: 18551 - RNA, 230 nt, unidentified
  source 1..230: mol_type = other RNA; note = Related to CP065748.1; note = Delftia lacustris
gcggagcgacgcgcaggctcttgcaacccgggtggtgtttcgccacccttgtgaactgccgtttcatgcaccacgggcgccgttttcactgtgccaccccagcgacggtatgcgttttcctgagtggcttgccacaagcgaaacacgcataccgtcgcggggtggcgtcgagcgaacagctcccgtcccgtgagccctgcgggctcttcgacgagaagcgcgtcgctcca

SEQ ID NO: 18552 - RNA, 230 nt, unidentified
  source 1..230: mol_type = other RNA; note = Related to NZ_CP069318.1; note = Delftia lacustris
gcggagcgacgcgcaggctcttgcaacccgggtggtgtttcgccacccttgtgaactgccgtttcatgcaccacgggcgccgttttcactgtgccaccccagcgacggtatgcgttttcctgagtggcttgctacaagcgaaacacgcataccgtcgcggggtggcgtcgagcgaacagctcccgtcccgtgagccctgcgggctcttcgacgagaagcgcgtcgctcca

SEQ ID NO: 18553 - RNA, 230 nt, unidentified
  source 1..230: mol_type = other RNA; note = Related to NZ_LR813084.1; note = Delftia tsuruhatensis
gcggagcaacgcgcaggctcttgcaatccgggtggtgtttcgccgcccttgtgaactgccgtttcatgcaccacgggcgccgttttcactgtgccaccccagcgacggtatgcgttttcctgagtggcttgccacaagcgaagcacgcataccgtcgcggggtggcgtcgagcgaacagcgcccgtcccgtgagccttgcaggctcttcgacgagaagcgcgttgctcct

SEQ ID NO: 18554 - RNA, 230 nt, unidentified
  source 1..230: mol_type = other RNA; note = Related to NZ_AUCQ01000016.1; note = Comamonas composti
gcggagcaacgcgcaggctcttgcaatccgggtggtgtttcgccacccatgtgaactgccgcttcatgcaccacgggcgccgttttcactgtgccaccccagtggtggtagtgcatttcctgagtggcttgccacaagcgaagctgcactaccaccacggggtggcgtcgagcgaacagctcccgtcccgtgagcctttcaggctcttcgacgagaagtgcgttgctcca

SEQ ID NO: 18555 - RNA, 230 nt, unidentified
  source 1..230: mol_type = other RNA; note = Related to NZ_SSWX01000040.1; note = Lampropedia aestuarii
tcggagcaacgcgcaggctcttgcaatccgggcggtgtttcgccgcccatgctctctgccgttctatgcaccacgggcgccgttttcactgtgccaccccagtcatggtgtcgcgcttcctcagtggcttgccacaagcgaagctgcgacaccatgacggggtggcgtcgagcgaacagctcccgtcccgtgagcccgatgggctcttcgacgagaagcgtgttgctccg

SEQ ID NO: 18556 - RNA, 230 nt, unidentified
  source 1..230: mol_type = other RNA; note = Related to NZ_CAKAKO010000003.1; note = Xenophilus sp.
gcgatgcagcgcgcaggctcttgccatccgggtggtgtttcgccgcccttgtgaactgccgttccatgcgacacgggtgccgttttcactgtgcggcccctgccacccatgcgccattccggagtggcttgctgcaagcgaatgcgcgcatgggtggcggggccgcgtcgagtgaacagcccccgtcccgagggccctgcgggctcttcgacgagaagcgcgctgcatca

SEQ ID NO: 18557 - RNA, 230 nt, unidentified
  source 1..230: mol_type = other RNA; note = Comamonadaceae bacterium; note = Related to SEAX01000108.1
ccgatgcaacgcgcaggctcttgcaatccgggcggtgcttcgccgcccttgtgaactgccgttccatgcgacacgggtgccgttttcactgtgcggcccctgccacccatgcgccattcctgagtggcttgctgcaagcgaatgcgcgcatgggtggcggggccgcgtcgagtgaacagcccccgtcccgagggccctgcgggctcttcgacgagaagcgcgttgcatca

SEQ ID NO: 18558 - RNA, 230 nt, unidentified
  source 1..230: mol_type = other RNA; note = Related to NZ_CP021455.1; note = Comamonas serinivorans
ttcgtgcaacgcgcaggctcttgcaacccggacggtgtttcgccgtccatgacctttgccgtttcatgcgccacgggggaccgttttcactgtgccgaacattggcctgctgtgcacttacgaagaggcttgcgacaagccaattgcacagcaggccaagttcggcgtcgagtgaacagcccccgtcccgtgagccttgcaggctcttcgacgagaagcgcgttgcacga

SEQ ID NO: 18559 - RNA, 223 nt, unidentified
  source 1..223: mol_type = other RNA; note = Related to CP028324.1; note = Massilia armeniaca
gcaagcatggcgggatggctcttgcaacccggacggtggatcgccgtcctcgtaccttgccctccccatgcgtcactggcccgctcttcactgtgccggaccagcactggtagcgcgagtcggtgtgaattccctgaattacatcagcgctaccagtgcggtccggcgtcgagttgagcggtccagtcctgccggcccttcgatgacggttccgccatgcttg

SEQ ID NO: 18560 - RNA, 223 nt, unidentified
  source 1..223: mol_type = other RNA; note = Related to NZ_CP038026.1; note = Massilia plicata
gcaagcatggcgggacggctcttgcaacccggacggcggatcgccgtcctcgtattcagccctccccatgcgtcactggcccgctcttcactgtgccagaccagcactggtagcgcgagtcggtgtgaattccctgaattacatcagcgctaccagtgcggcctggcgtcgagttgagcggtccagtcctgccggcccttcgatgacggtcccgtcatgcttg

SEQ ID NO: 18561 - RNA, 221 nt, unidentified
  source 1..221: mol_type = other RNA; note = Related to CP040017.1; note = Massilia umbonata
caagcatggcgcgatggctcttgcaacccggacggcggatcgccgtcctcgtatcctgctccccccatgcgccactggcccgctcttcactgggccggaccagcgctggcagcgcgagtcggtgtgaatcccatgaattacgccagcgctaccagcgcggtccggcgtcgagttgagcggtccagtcctgccggcccttcgatgacggtcgcgccatgctt

SEQ ID NO: 18562 - RNA, 221 nt, unidentified
  source 1..221: mol_type = other RNA; note = Related to WSES01000020.1; note = Massilia sp.
caggtgcggcgggatggctcttgcaaaccggacggtggatcgccgtccacgtattcagccctccccatgcgtcactggcgcgctcttcactgtgccaaactgacgccggtagcgcgagtcggtgtgaattcgccgaattacgtcagcgctaccggcgtcgtttggcgtcgagttgagcgcgccagtcctgccggcccttcgatgacgatcccgccgcacct

SEQ ID NO: 18563 - RNA, 223 nt, unidentified
  source 1..223: mol_type = other RNA; note = Related to BMKG01000047.1; note = Massilia buxea
gcaagcatggcgggatggctcttgcaacccggacggcggatcgccgtcctcgtatcctgctctccccatgcgtcactggcccgctcttcactgggccggaccagcccgggtagcgcgagtcggtgtgaattccatgaattacatcagcgctacccgggcggtccggctacgagttgagcggtccagtcctgccggcccttcgatgacggtcccgccatgcttg

SEQ ID NO: 18564 - RNA, 223 nt, unidentified
  source 1..223: mol_type = other RNA; note = Related to NZ_CP024608.1; note = Massilia violaceinigra
acaagcacggcgggatggctcttgcaaaccggacggcggatcgccgtccacgttgtcagctcttcccacgcgtcactggcacgctcttcactgtgccgtacctgcaccagtagcgcgacacggtttggcttccctgaagccgatcagcgctactggtgcggtacggcgtcgagtggagcgctccagtcctgcaggcccttcgatgattatcctgccgtgcttg

SEQ ID NO: 18565 - RNA, 223 nt, unidentified
  source 1..223: mol_type = other RNA; note = Related to NZ_AUDI01000031.1; note = Pseudoduganella violaceinigra
gcaaacacggcgggatggctcttgcaattcgaacggtggatcgccgttctcgtattcagctcttcccatgcgccactggcacgctcttcacagtgccatacaggccctggtgtggcaagacggtgtgactgcccggcagtccattcgccacaccagggccgtatggcatcgagtggagcgccccagtcttaaaggctcttcgatgacaacccggccgtgtttg

SEQ ID NO: 18566 - RNA, 223 nt, unidentified
  source 1..223: mol_type = other RNA; note = Related to LMFZ01000021.1; note = Duganella sp.
gcaaacacggcgggatggctcttgcaacccgaacggcggatcgccgttcacgtattcagctcttcccatgcgccactggcacgctcttcacagtgccatacagacaccagtgcagcaagacggtgtgactgccctgcagtccattcgccgcactggtgtcgtatggcatcgagtggagcgccccagtcttaaaggctcttcgatgacaatcccgccgtgcttg

SEQ ID NO: 18567 - RNA, 223 nt, unidentified
  source 1..223: mol_type = other RNA; note = Related to NZ_WWCJ01000033.1; note = Massilia guangdongensis
gcaaacacggcgggatggctcttgcaaaccgaacggcgcatcgccgttcacgtattcagctcttcccatgcgccactggcacgctcttcacagtgccatacaggccccggtgtcgcaagacggtgtgactgcccggcagtccattcgcgacaccggggccgtatggcatcgagtggagcgccccagtcctaaaggctcttcgatgacgatcccgccgtgcttg

SEQ ID NO: 18568 - RNA, 219 nt, unidentified
  source 1..219: mol_type = other RNA; note = Related to NZ_NSJF01000005.1; note = Vandammella animalimorsus
cgggcgtacgggcaaggctcttgcatcctgggtggtggatcgccatccgcgttgtttgctctgtcatgcgtcactggcgcactcttcactgtgccgatggcgctacccgccgcttttgccgtttgacttccttgaagtcaaacagcggagggtagcccatcggcgtcgagtggagcgcgcaagtccgaaggcttcttcgatgagaacgcccgtacgccc

SEQ ID NO: 18569 - RNA, 220 nt, unidentified
  source 1..220: mol_type = other RNA; note = Related to NZ_VIRW01000011.1; note = Chitinibacter sp.
atggtgtggtggggaggctcttgcaacccggctggtgcatcgccagccttgtcttttgctgttccacgcgtcactggcctgttcttcactgggccggtacgtgctacctgcgacatgacggtgcggcttgtgccaagcccaatgtcgcaggtagcacgtaccggcttcgagtggaccagtccagtcttacaggctcttcgatgagaaccctgccacaccc

SEQ ID NO: 18570 - RNA, 221 nt, unidentified
  source 1..221: mol_type = other RNA; note = Related to NZ_SCOH01000042.1; note = Chitinivorax sp.
aatgcgtagcggggaggctcttgcaacccggatggcggatcgccattcatgcttaaagctgtcccacgcgtcactggcccgctcttcactgggccggggcgtgctaccagcgacatgacggttcggcttgttccaagctcgatgtcgccggtagcacgccccggctttcgagtggagcagtccagtctacaaggctcttcgatgagaaccccgctacgcac

SEQ ID NO: 18571 - RNA, 221 nt, unidentified
  source 1..221: mol_type = other RNA; note = Related to JAEUND010000226.1; note = Chitinimonas sp.
tcgcgtatggcggggtggctcttgcaacccggacggtggatcgccgtccttgtacctagctgccccacgcgtcactggcctgctcttcactgggccgtaacacacccctagcgccatgacggtgcggcttgtgccaagcccgatggcgctaggggtgcgttacggcttcgagtggaacagtccagtctacaaggctcttcgatgagaaccccgccatcgcg

SEQ ID NO: 18572 - RNA, 221 nt, unidentified
  source 1..221: mol_type = other RNA; note = Related to NZ_KB892857.1; note = Uliginosibacterium gangwonense
gcgcagcagcggggtggctcttgcaacccgggtggtggatcgccgcccttgttttcagccctcccacgcgtcactggcccgctcttcactgtgcgggacagcactacctgtcgcaatggcggttgggcttgctacaagcccattagcgacaggtagtgcgtcccgcgtcgagtggagcgctccagtttgacaggctcttcgatgagaaccctgctgctgcg

SEQ ID NO: 18573 - RNA, 219 nt, unidentified
  source 1..219: mol_type = other RNA; note = Related to NZ_JACOGF010000004.1; note = Undibacterium hunanense
cgaacaaggcaggaaggctcttgcaatccggatggtgtatcgccatccatgtactttgcttagctatgcatcactgagtttctcttcactgtgccggatacgactgctggcgcaatgacgatgtggattccgtgaaccccattcgcgccagcagtcgtatccggcgtcgagtggagcctctcagtctgaaggctcttcgatgagcttcctgcctttttc

SEQ ID NO: 18574 - RNA, 207 nt, unidentified
  source 1..207: mol_type = other RNA; note = Related to JAKZHX010000005.1; note = Undibacterium sp.
aggcaggaaggctcttgcaatccggatggtgtatcgccattcatgtagtttgcttagctatgcatcactgagtttctcttcactgtgccgtatcacactaccggcgcaatgacgatgtggattccgtgaaccccattcgcgccggtagtgcgatacggcgtcgagtggagcctctcagtctgaaggctcttcgatgagcttcctgcc

SEQ ID NO: 18575 - RNA, 218 nt, unidentified
  source 1..218: mol_type = other RNA; note = Related to NZ_QJKB01000012.1; note = Undibacterium pigrum
agattttggcaggaaggctcttgcaatccggatggtgtatcgccatccatgttttttgcttagctatgcatcactgagtttctcttcactgtgccggaaggacataccggcgtgatgacgatgtggattccgtgaaccccatcacgccggtatgtccttccggcgtcgagtggagcctctcagtctgaaggctcttcgatgagcttcctgccgctttc

SEQ ID NO: 18576 - RNA, 222 nt, unidentified
  source 1..222: mol_type = other RNA; note = Related to NZ_RXFT01000001.1; note = Variovorax guangxiensis
gcgaacggagcgggaaggctcttgcaatccggtcggcgtatcgccgccctcgcatacagcacttcccaagcgtcactggacgtctcttcactgtgccggatggccatggtgacgcgacaacagtgcggcttcctcgaagctcatcggcgtcaccatggccatccggcgtcgagtggagccctccagtcccgaggctcttcgacgagattcccgcttcgttcg

SEQ ID NO: 18577 - RNA, 222 nt, unidentified
  source 1..222: mol_type = other RNA; note = Related to NZ_CP060295.1; note = Variovorax sp.
gcgaacggagcgggaaggctcttgcaatccgggtggcgtatcgccaccctcgcacacagcacttcccaagcgtcactggacgtctcttcactgtgccgtaggtgcacggtggcgcgatgacagtgcggcttcctcgaagctcatcggcgccaccgtgcacctacggcgtcgagtggagccctccagtcccgaggctcttcgacgagattcccgccccgttcg

SEQ ID NO: 18578 - RNA, 222 nt, unidentified
  source 1..222: mol_type = other RNA; note = Related to NZ_CP091716.1; note = Variovorax paradoxus
gcgaacggagcgggaaggctcttgcaatccggttggcgtatcgccaccctcgcacacagcacttcccaagcgtcactggacgtctcttcactgtgccgtaggtgcacggtggcgcgacaacagtgcggcttcctcgaagctcatcggcgccaccgtgcacctacggcgtcgagtggagccctccagtcccgaggctcttcgacgagattcccgcttcgttcg

SEQ ID NO: 18579 - RNA, 221 nt, unidentified
  source 1..221: mol_type = other RNA; note = Related to CP063166.1; note = Variovorax paradoxus
gcgaacggggcgggaaggctcttgcaatccggatggcgcatcgccatcctcgatctcagcacttcccaggcttcactggacatctcttcactgtgccgtacgcgcatggtggcgcgatgacggtgcggcttcttcgaagctcatcgcgccaccatgcgcgtacggcgtcgagtggagctgtccagtcctcaggctcttcgacgagattcccgtcccgttcg

SEQ ID NO: 18580 - RNA, 216 nt, unidentified
  source 1..216: mol_type = other RNA; note = Related to NZ_JAGSPN010000003.1; note = Undibacterium luofuense
cagttggcaggaaggctcttgcaacccgaatgatgtttcgtcattcttgcagtatgtcttgttatgcatcactgagccgctcttcactgtgccgtatatgactaccggcgcaatgacgatgcgggttccgtgaacctcattagcgccggtagtcatatacggcgtcgagtggagcttctcagtaccagaggctcttcgatgagcttcctgccctct

SEQ ID NO: 18581 - RNA, 216 nt, unidentified
  source 1..216: mol_type = other RNA; note = Related to NZ_BMYU01000002.1; note = Undibacterium squillarum
cagacggcaggaaggctcttgcaacccgaatgatgtttcgtcattcttgcagtatgtcttgttatgcatcactgagccgctcttcactgtgccgtatatgactaccggcgcaatgacgatgcggggtccgtgaccctcattggcgccggtagtcatatacggcgtcgagtggagcttctcagtaccagaggctcttcgatgagcttcctgccctct

SEQ ID NO: 18582 - RNA, 224 nt, unidentified
  source 1..224: mol_type = other RNA; note = Related to JAFGZG010000009.1; note = Methylobacterium goesingense
ggggcgtcggccggagcggaccttgcaccctgggcggcgcttcgccgtccctgcaccctgcccggcaaagcgtcactggcccgctcttcactgggccggcactgacctcccccgcgcgctttcggtttgggttccttgaacccaagcgcgcgggggaggtcgtgccggcatcgagtggaccgggccagtcccgagacttgacgaaggctttccggccggcgtcc

SEQ ID NO: 18583 - RNA, 224 nt, unidentified
  source 1..224: mol_type = other RNA; note = Related to BPQF01000021.1; note = Methylobacterium bullatum
gggacgtcgggcggagcggaccttgcaacctgggcggcgtttcgccgtccctgcaccctgcccggcaaagcgtcactggcccgctcttcactgggccggcacagacccctaccgcgcgctttctgtttgggttccttgaacccaaacgcgcggtaggggtcgtgccggcatcgagtggaccggaccagtcccgagacttgacgaaggctttccggccggcgtcc

SEQ ID NO: 18584 - RNA, 224 nt, unidentified
  source 1..224: mol_type = other RNA; note = Related to JACHWM010000004.1; note = Methylobacterium sp.
ggggagtcggcgggggcggaccttgcatcctgggcggcgtttcgccgtccctgcaccctgcccggcaaagcgtcaccggcccgctcttcactgggccggcactgaccaccccggcgcgttctcgatttgggttccctgaacccaaacgcgccggggtggtcgtgccggcttcgagtggagcgcgccggtcccgagacttgacgaaggcatcccgaccggcgccc

SEQ ID NO: 18585 - RNA, 224 nt, unidentified
  source 1..224: mol_type = other RNA; note = Related to CP001001.1; note = Methylobacterium radiotolerans
ggggcgccggccggggcggaccttgcatttcgggcggcgattcgccgtccctgcaccctgcccggcaaagcgtcactggcccgctcttcactgggccggcactgaccaccggtgcgcgttcgcggtttgggttcgctgaacccaaacgcgcaccggtggtcgtgccggcgtcgagtggaccgggccagtcccgagacttgacgaaggcatcccggccgacgtcc

SEQ ID NO: 18586 - RNA, 224 nt, unidentified
  source 1..224: mol_type = other RNA; note = Related to NZ_JACJIM010000008.1; note = Methylobacterium fujisawaense
ggggcgtcggccggggcggaccttgcatttcgggcggcgattcgccgtccctgcaccctgcccggcaaagcgtcactggcccgctcttcactgggccggcactgaccaccggtgcgcgttcgcggtttgggttcgctgaacccaaacgcgcaccggtggtcgtgccggcgtcgagtggaccgggccagtcccgagacttgacgaaggcatcctggccgacgtcc

SEQ ID NO: 18587 - RNA, 224 nt, unidentified
  source 1..224: mol_type = other RNA; note = Related to NZ_FOPM01000031.1; note = Methylobacterium gossipiicola
ggggcgtcggcagggacggaccttgcattccgggcggcgtttcgccgtccctgcaccctgcccggcgaagcgtcaccggcccactcttcactgggccggcactgaccaccccggcgcgttctcgatttgggttccttgaacccaaacgcgccggggtggtcgtgccggcttcgagtggagtgcgccggtcccgagacttgacgaagacatcccggtcggcgccc

SEQ ID NO: 18588 - RNA, 224 nt, unidentified
  source 1..224: mol_type = other RNA; note = Related to NZ_CABFVH010000047.1; note = Methylobacterium dankookense
ggggcgccggccggagcggaccttgcactccgggcggcgtttcgccgtccctgcaccctgcccggcaaagcgtcactggcccgctcttcactgggccggcactgaccacccccgcgcgttcccggtttgggttccctgaacccaaacgcgcgggggtggtcgtgccggcttcgagtggaccggaccagtcccgagacttgacgaaggcattccggccggcgccc

SEQ ID NO: 18589 - RNA, 224 nt, unidentified
  source 1..224: mol_type = other RNA; note = Related to NZ_CAKLBV010000001.1; note = Methylobacterium sp.
ggggcgtcgtccggggcggaccttgcatcctgggcggcgtttcgccgtccctgcaccctgcccggcaaagcgtcaccggcccgctcttcactgggccggcactgaccacccggctccgttcgcggtttgggttcgctgaacccaaacggtgccgggtggtcgtgccggcatcgagtggagcgggccggtcccgagacttgacgaaggcatcccggccggcgtcc

SEQ ID NO: 18590 - RNA, 224 nt, unidentified
  source 1..224: mol_type = other RNA; note = Related to NZ_JACHOP010000028.1; note = Methylorubrum rhodinum
ggggcgcctgccggggcggaccttgcatcccgggcggcgtttcgccgtccctgcaccctgcccggcaaagcgtcaccggcccgctcttcactgggccggcactgaccacccggcggcgttcgcggtttgggttcgccgaacccaaacgccgccgggtggtcgtgccggcatcgagtggagcgtgccggtcccgagacttgacgaaggcattccggccggcgtcc

SEQ ID NO: 18591 - RNA, 224 nt, unidentified
  source 1..224: mol_type = other RNA; note = Related to NC_011894.1; note = Methylobacterium nodulans
ggggcgccggccggcgaggaccttgcaacccgggcggcgtttcgccgtccttgcaccctgcccggcaaagcgtcactggcccgctcttcactggggcggcacaggccaccggtgcgggtttacggtttgggttccctgaacccaaacccgcaccggtggccgtgccgccttcgagtggagcgggccagtcccaggacgagacgaaggcgagccgtccggcgtcc

SEQ ID NO: 18592 - RNA, 224 nt, unidentified
  source 1..224: mol_type = other RNA; note = Related to NZ_JAFBCY010000002.1; note = Methylopila capsulata
ggggcgccggacggcgaggaccttgcaacccgggcggcgcttcgccgtccttgcaccttgccccaccacgcgtcactggcccgctcttcactggggcggcgctcgggacctgtgcggtcttacggtttgggttcgttgaacccaagaccgcacaggtcccggcgccgccttcgagtggaccggtccagtcccaggacgagacgaaggcgaaccgtccggcgccc

SEQ ID NO: 18593 - RNA, 224 nt, unidentified
  source 1..224: mol_type = other RNA; note = Related to NZ_JACIDN010000003.1; note = Methylobacterium brachythecii
gggacgcaggcaggacaggaccttgcaacccgggcggcgcttcgccgtccctgcttcttgccctgcaatgcgccactggcccggtcttcactgggggaccccagaccaccggtgcggatttacagtttgggttccttgaacccaaatccgcaccggtggtcggggtcccttcgagtggaccgcgccagtcctcagatgagacgaaggcaacccggcctgcgtcc

SEQ ID NO: 18594 - RNA, 224 nt, unidentified
  source 1..224: mol_type = other RNA; note = Related to NZ_LABY01000112.1; note = Methylobacterium variabile
gggacgcgggctggacaggaccttgcaacccgggcggcgcttcgccgtccctgcaccctgccctgcaatgcgccactggcccggtcttcactgggggaccccaggcccctggtgcggatgtacggtttgggttccttgaacccaaatccgcaccaggggccggggtcccttcgagtggaccgcgccagtcctcagatgagacgaaggcaatccggccggcgtcc

SEQ ID NO: 18595 - RNA, 224 nt, unidentified
  source 1..224: mol_type = other RNA; note = Related to NZ_SNZR01000011.1; note = Enterovirga rhinocerotis
ggggcgccggtcggacaggaccttgcaacctgggcggcgtttcgccgtccctgcaccctgcccggcaaagcgtcactggcccgctcttcactgggggaccccagcccacccgtgcggatttccagtttgggttccttgaacccaaatccgcacgggtgggcggggtcccttcgagtggaccgagccagtcccgagatgagacgaaggcatcccggccggcgccc

SEQ ID NO: 18596 - RNA, 224 nt, unidentified
  source 1..224: mol_type = other RNA; note = Related to VOHA01000021.1; note = Reyranella sp.
ggggcgccagccggagcggaccttgcaacccgggcggcgtttcgccgtccttgcaccctgcctggcaaagcgtcactggcccactcttcactgggccggcacagaccaccgtcgcgcttttgcaatatgggtttctaaaacccaaaagcgcgacggtggtcgtgccggcttcgagtggaccgggccagtccttggatccgacgaaggcatcccggccggcgccc

SEQ ID NO: 18597 - RNA, 224 nt, unidentified
  source 1..224: mol_type = other RNA; note = Related to NZ_LLXZ01000195.1; note = Bradyrhizobium jicamae
agggcgcaggctggtcaggaccttgcaacccgggcggcgtatcgccgtccttgcaccatgaccatgcatgcgtcactggcccgatcttcactgggccggggcagtccacccatccgcaatcgcagaatgggttccttgaacccaattgcggatgggtggacgccccggcgtcgagtggatcgatccagttcttggatgagacgaaggcaatccggcctgcgccc

SEQ ID NO: 18598 - RNA, 224 nt, unidentified
  source 1..224: mol_type = other RNA; note = Related to NZ_LFLZ01000017.1; note = Bradyrhizobium tropiciagri
agggcgcaggccggtcaggaccttgcaacccgggcggcgtatcgccgtccttgcaccatgaccacgcatgcgtcactggcccgatcttcactgggccggggcagtccacccctacgcaatcgcagaatgggttccttgaacccaattgcgtaggggtggacgccccggcgtcgagtggatcgatccagttcttagaagagacgaaggcaatccggcctgcgccc

SEQ ID NO: 18599 - RNA, 224 nt, unidentified
  source 1..224: mol_type = other RNA; note = Related to NZ_CP043489.1; note = Labrys sp.
agggcgcgggccggtcaggaccttgcaacccgggcggcgtatcgccgtccttgctacatgaccgtgcacgcatcactggcccaatcttcactgggcggggactgcctaccggtgcgctattgcagattgggttccttgaacccaatagcgcaccggtaggcgtccccgcttcgagtggattgatccagtccttggatgagacgaaggcagcccggcctgcgccc

SEQ ID NO: 18600 - RNA, 222 nt, unidentified
  source 1..222: mol_type = other RNA; note = Related to NZ_FNFO01000004.1; note = Catalinimonas alkaloidigena
gcagtgacgcagcctccacaccttgcaacccgggcggtggatcgccgtccatgcacgtagctttcgctcgcatcacaggcacactcttgacggtggctggtacactactacccctgattgcagtgtgatttccgggaactcaatgcgtaggggtagtagtgtaccagccttgagttgagtgctcccgtccccagaatgttcgaaggtaggctcgcgtcactg

SEQ ID NO: 18601 - RNA, 221 nt, unidentified
  source 1..221: mol_type = other RNA; note = Related to CADCTQ010000349.1; note = Cytophagales bacterium
cagtgagttcaccaaccgtaaccttgcaaaccgggcggtgcttcgccgtccttgaatacagactacactcgcgtcacaggcctgctcttcactttagcccgtagagggtagtagagagactgcggtgtgacttcgggaagtcaatgctcctctactaccctctacgggcatcgagttgagcattcccgtcccaagaatgtacgaaggtttggtgactcact

SEQ ID NO: 18602 - RNA, 220 nt, unidentified
  source 1..220: mol_type = other RNA; note = Related to JACMKY010000311.1; note = Ferruginibacter sp.
cagtgacctagccaaacagaccttgccaaccgggcggtgcatcgccgtccttgcttacagactaccctcgccccacgggccggctcttgactaagcggtaggcggtaggtgagcctatttcggtgggcattcgtgaatgaaatgatgcccacctaccgcctaccgcctcgagttgagccatcccatcccgagaattgtacgaaggtttggcgaagtcact

SEQ ID NO: 18603 - RNA, 217 nt, unidentified
  source 1..217: mol_type = other RNA; note = Related to JADLDL010000134.1; note = Saprospiraceae bacterium
ttcagttaccgaattcaaaaccttgcaaaccgggcggtgtttcgccgtccatgcacacagacaaatcttgcttcacaggcttgctcttcactatggccggtagatatagtaccggggcttgcggtgtgaattcaggaattcaagactcccggtactatacctaccggcgtcgagttgagcattcctgtcctatgattgtacgaaggtttggtactga

SEQ ID NO: 18604 - RNA, 219 nt, unidentified
  source 1..219: mol_type = other RNA; note = Candidatus Entotheonella factor; note = Related to KI932172.1
cctgcggtgtggtcatagtcttgcctcatgggcggtgtatcgccgtccttgtaacttgacttgacatgcttcactggcccgctctcgactgtgcggagcaatgcctacccaaagccgtcgcggtttggattcggagaatccgacggccctgggttggcgctccgcttgagttgagcgttccagtcctgagtggttttcgaagaccgcaccacgccgtag

SEQ ID NO: 18605 - RNA, 219 nt, unidentified
  source 1..219: mol_type = other RNA; note = Related to PPXO01000342.1; note = Candidatus Entotheonella serta
ccatagtgcggtcgtaagtcatgcctcgtgggcggtgcatcgccgtccttgcaacttgacttcacatgcttcactggcctgctctttactgtgcggagcagtcccaccatggggtgtcgcggtttggattcggagaatccgacaacccccttggtgggcgctccgcttgagttgagcgttccagtcctgagtggttttcgaagaccgcactgcgctatg

SEQ ID NO: 18606 - RNA, 227 nt, Calothrix parasitica
  source 1..227: mol_type = other RNA; note = Related to NZ_AP018227.1
gcgcactaattggttagaaatccttgcaatctggatgatgtatcgtcatccttgtgtatagtccagacacgcatcactagcctgctctttactgtgcggtatctcacctactgggggactttacggtttgacttccgtgaagttaaagttcccccagtaggtggataccgcttgagttgagcagtctagtcctgagatatttacgaaggggataccaataaagtgcg

SEQ ID NO: 18607 - RNA, 221 nt, Calothrix sp.
  source 1..221: mol_type = other RNA; note = Related to NZ_VLKB01000009.1; note = Calothrix desertica
taagcgcgctggtaaagattccttgcaaattgggcggtgtatcgccgtccgtgcattcagtctatacacacatcactagtctactcttgactgtgcggtcttacgactagtaggcgcattcctgtttgacttatataaagtgaatgggcgcctactagtcgtgaccgcttgagttgagtaacctagtccccagagatttacgaagggaaaccagcgcgcaa

SEQ ID NO: 18608 - RNA, 213 nt, unidentified
  source 1..213: mol_type = other RNA; note = Related to JAHHIC010000071.1; note = Scytonematopsis contorta
agttggtaaaaaaatccttgcaaaccggatggtgtatcgccatccatgcgctgagttataacatgcaatcactagtctactcttgactgtgcggttattcagtactacctccgaatttcggattgacttccaagaagtatatgtcggaggtagtactgaaaccgcttgagttgagtagcctagtcctaagggatttacgaaggggataccagc

SEQ ID NO: 18609 - RNA, 260 nt, Calothrix sp.
  source 1..260: mol_type = other RNA; note = Related to NZ_VLKB01000007.1; note = Calothrix desertica
agctagtcgtaagtattaaccttgcaatccggacgatgtatcatcgtccttgcgctgagtctatacatgcttcactagccagttctttacggcgctccgccacccagtgtcgcggtttggtttctgtaaaaccgacgactctaaatggctaaatcctaacagcacccgagactagcaatcttggtataatgcttgtgggtggctccgctgagtaaaactgtctagtctcgggtgatttacgaaggggtttacaaactagc

SEQ ID NO: 18610 - RNA, 263 nt, Calothrix sp.
  source 1..263: mol_type = other RNA; note = Related to NZ_AP018172.1
tgctagctaaatgtaattaccttgcaacccggacagtgtatcactgtccttgcgctaagttgaaacatgcatcactagcctgctctttacggcgctccgccacccagtgtcgcggtttggtttctgtaaaaccgacgactaactagtagccaacttactcgttagttgccgagatttagatactggttcgataggttggggggtggctccgctgagtagagcagtctagtcctgagaggtttacgaagggtttacaagctaga

SEQ ID NO: 18611 - RNA, 223 nt, Tolypothrix sp.
  source 1..223: mol_type = other RNA; note = Related to NZ_JHEG04000001.1; note = Tolypothrix bouteillei
cttaattgttggtaaaaaatccttgcaatctgggcggtggatcgccgtccgtgcgtttagtttagccatacatcactagcccactcttgactgtgcggtcttacggtactaccatggtattccgggttgacatccatgtagtgaatgacccaggtagtaccgtgaccgctgagttgagttgtctagtcctgagggatttacgaagggaaagccaacttattaa

SEQ ID NO: 18612 - RNA, 214 nt, unidentified
  source 1..214: mol_type = other RNA; note = Related to NZ_JTCM02000014.1; note = Hassallia byssoidea
atttgttgagttgaaaccttgcaatttgggcgatggttcgtcgtccttgcgtttagcctaatcatacatcactagcctactcttgactgtgcggtcttacggaagctatcgctattccggtttgacttctacgaagtgaatgaagcgatagcttccgtgaccgcttgagttgagtagtctagtccagagggatttacgaagggaaaccaacaaa

SEQ ID NO: 18613 - RNA, 223 nt, unidentified
  source 1..223: mol_type = other RNA; note = Related to NZ_JAAKGC010000016.1; note = Aetokthonos hydrillicola
gtttgccgttggtagacaatccttgcaatttgggcggtgcgatcgccgtccttgtgtttagcctatacatgcatcactagcctgctcttaactgtgcggtctttcggcagtaggtcgtattccggtctgacttccgtgaagtgaaagcacgacctactgccgagaccgcttgagttgatcagtctagtccaaaggggtttacgaagggaaagctaacggaaaa

SEQ ID NO: 18614 - RNA, 221 nt, Phormidium ambiguum
  source 1..221: mol_type = other RNA; note = Related to NZ_MRCE01000029.1
ataccagtaggcaccaacaaccttgcattctggacagtggatcgctgtccttgcgcttagtccgcccacgcatcactagcccgctcttgactgtgcctatactcaggtactatcgctattacggtttggtttccgtgaaactaatgagcgatagtacctggtataggctggagttgagcgatctagtcctgagatgtttacgaaggggaaacctactggga

SEQ ID NO: 18615 - RNA, 220 nt, unidentified
  source 1..220: mol_type = other RNA; note = Related to JACJPW010000041.1; note = Planktothrix sp.
acgccagaaggcccaacagccttgcaatccgggcagtggatcgctgtccttgcgtttagttcgatcgcgcatcactagcccgctctttactgtgcgtagtgtcaggtagtatcgctattacggtttggtttccgcgaaactaatgagcgatactacctgcactacgcttgagttgatcggtctagtcctgagatgtttacgaaggggcaacctgatggca

SEQ ID NO: 18616 - RNA, 222 nt, unidentified
  source 1..222: mol_type = other RNA; note = Related to NZ_JACJTV010000005.1; note = Coleofasciculus sp.
cctaatcagttggtaaacagccttgcaatccggacgatggatcgtcgtccttgcgtttagcctagccatgcaccactagcctgctcttaactgtgcggtcattcagggctacccccttttccggtgggacttccctgaagtgtaagaagggggtagccctgagaccgcttgagttgagcaatctagtcctgagatgtttacgaaggggcaaccaactgacag

SEQ ID NO: 18617 - RNA, 223 nt, unidentified
  source 1..223: mol_type = other RNA; note = Cyanobacteria bacterium UBA11153; note = Related to DOIX01000137.1
cggtattcgttggtaaacagccttgcaattcggatggtggatcgccattcatgcgcatagccaaagcacgcatcactagcctgctctttactgtgcctaccccactactacctggtattccggttggactttcttaaagtgaataaaccaggtagtagtggggtaggctggagttgagcaatctagtccagaggggtttacgaaggggcaaccaacgaatagc

SEQ ID NO: 18618 - RNA, 194 nt, unidentified
  source 1..194: mol_type = other RNA; note = Related to NZ_NXIB02000033.1; note = Tychonema bourrellyi
tttgatccttgggggaaagaggtgatttgcgcgcgatcgattagttgagacaagcatcactagccagctcttgactgtgcggggcttcaggtactactgctattgcggtttggcttccgtgaagccaatgagcagtagtacctggccccgctggagttgagcagtctagtcctagggggtttacgaaggggcaa

SEQ ID NO: 18619 - RNA, 221 nt, Oscillatoria sp.
  source 1..221: mol_type = other RNA; note = Related to NZ_KB235948.1
gctaattacgaggtaaacagccttgcaatccgggcggtggatcgccgtccttgcgctcagtccagacacgcatcactagcctgctcttgactgtgcggtcattcgggtactgtcgcaattccagtgtgacttccgcgaagtgaatgagcgacagtacccgagaccgcttgagttgagcagtctagtcctgaggggtttacgaaggggcaaccaaagcttag

SEQ ID NO: 18620 - RNA, 223 nt, Synechocystis sp.
  source 1..223: mol_type = other RNA; note = Related to NZ_ALVU02000001.1
taattttagttggtaacagccttgcaatccggatggtggatcgccatccttgcgtttagttcaagcacgcatcactagctcgatcttgactgtacggtcattcgccctagtacgccctacccggtgggacttccatgaagtgtaaaaggcgtactagggcgagaccgcttgagttgatcgatctagtcctgagaggtttacgaaggggcaaacaactgataat

SEQ ID NO: 18621 - RNA, 222 nt, unidentified
  source 1..222: mol_type = other RNA; note = Related to NZ_MKZS01000001.1; note = Moorena bouillonii
ttccatcagttggtaaacagccttgcaatctgggcggtggatcgccgtccctgcgataagttcaaccacgcatcactagcctgctcgtgactgtgcgggctatcgggtgctatcgctattacggtttcgttttcctaaaactaattagcgatagcacccgagcccgcttgagttgagcagtctagtccgagggagtttacgaaggggtaaccaacggagtgg

SEQ ID NO: 18622 - RNA, 224 nt, unidentified
  source 1..224: mol_type = other RNA; note = Blastocatellia bacterium; note = Related to JAEUQL010000156.1
ttggagagtttgacataagccttgcaatccgggcggtggatcgccgtccatgttttcagtctaagcacgcatcactggtcagctcttcactatgcgggacaatgtctctggtgtagatattccggtgtcgttttcgtaaaccgaatagtctacaccagagacgtcccgcttgagttgagcatgcccagtcctcttgtcttttcgaaggggttgtcaaaactcca

SEQ ID NO: 18623 - RNA, 223 nt, unidentified
  source 1..223: mol_type = other RNA; note = Related to JACMLN010000050.1; note = Anaerolineae bacterium
gcaacgaaagggtgccatgaccttgcaacccggatggtggatcgccatccttgcgctgagtccaagccatgcatcactggttcgctcttgacgttgcggcctaagcgggtagtagtgctattccggtggggcaagcgccttgcgaatgagcactactacccgcagtccgcttgagttgagcaacccagtcctgagttgtttacgaaggaacactctttcgaag

SEQ ID NO: 18624 - RNA, 222 nt, Pseudanabaena sp.
  source 1..222: mol_type = other RNA; note = Related to NZ_ALWB01000094.1
gcagtcataagggcaaacaaccttgcaatccgaatggtggatcgccattcttgcatttagtctaagcgcgcatcactggcttgctcttaactgtgcgtctctcgctactagtgtgttattacggtttggcttccgaaaagctaacgaacacactagtagcggagccgctggagttgagcaatccagtcctgagaggtttacgaaggagtaacctgttgactg

SEQ ID NO: 18625 - RNA, 220 nt, unidentified
  source 1..220: mol_type = other RNA; note = Related to MQTZ01000030.1; note = Leptolyngbya sp.
gtagaggcggaacgtcaaaccttgcaatccggatggtggatcgccatccttgtggttagtctaaacgcgcatcactggcccgctcttaactgtgcgtctctccgggtactatcgctgttacggtgtcgtttccgcgaagctaacgagcgatagtacccgggagccgcttgagttgagcgatccagttccagggggtttacgaaggaaggttccgccagtg

SEQ ID NO: 18626 - RNA, 223 nt, Pseudanabaena sp.
  source 1..223: mol_type = other RNA; note = Related to NZ_KB235911.1
agcgatcgcggggaaaacgaccttgcaatccgggtggtggatcgccatccatgtacttagtctaaacgcgcatcactggctcgctcttgactgtgcgttactcggagtacccatgctattacggtgtagtttccgtgaaactaacgagcacgggtactccggtaccgcttgagttgagcgatccagttctgagaggtttacgaaggggataacccgcgatcgc

SEQ ID NO: 18627 - RNA, 221 nt, Calothrix sp.
  source 1..221: mol_type = other RNA; note = Related to JAAUPE010000002.1
gttacgtgacaaggaaataccgcttgcaaaccggatgatggttcgtcatccatgcacacagtccagtcacacatcactggctcgctcttaactatgcgggtcttcgggtactagttggtattacggtgtgaattccgtaaattcaatgaccaactagtacccggacccgctcgagttgaccgttccagtcctgagaggcttacgaagaggctcccacgtaa

SEQ ID NO: 18628 - RNA, 214 nt, Chamaesiphon minutus
  source 1..214: mol_type = other RNA; note = Related to NC_019697.1
actgtgcggcgcataccacttgcaatccggatgatggatcgtcatccttgcgtttagtctagccacacatcactagcgcgctcttaactgtgccgatatcacctaatacctgctattgcagtgcagactccatgagtccaatgagcaggtattaggtgtatcggctggcgttgagcgagctagtctcgggggtttacgaagaggagccgcacag

SEQ ID NO: 18629 - RNA, 220 nt, unidentified
  source 1..220: mol_type = other RNA; note = Related to JAAUOP010000014.1; note = Synechococcales cyanobacterium CRU_2_2
ctgaatctgttcaaaaaccccttgcaacccgaatggtggatcgccattcatgcagttagtctagccgcgcatcactggcttgctcttaactatgcgggtcttcggggtaccgtcgctattccggtgtggattccacgaatcgaatgagcgacggtaccccggacccgctcgagttgagcaatccagtcctgagaggtttccgaagcggtgaacagattcg

SEQ ID NO: 18630 - RNA, 221 nt, unidentified
  source 1..221: mol_type = other RNA; note = filamentous cyanobacterium LEGE 11480; note = Related to JADEXQ010000025.1
actattccatccatgagtccccttgcaatccgggtggtggatcgccatccatgcagttagtctagccgcgcaccactggcttgctcttaactatgcgggtcttcgccctactgtcgctattccggtgcagattccgtgaatcgaatgagcgacagtagggcggacccgctcgagttgagcaatccagtcctgagaggttcccgaagaggcggatggaaaaa

SEQ ID NO: 18631 - RNA, 223 nt, unidentified
  source 1..223: mol_type = other RNA; note = Related to NC_009925.1; note = Acaryochloris marina
tcggtcagtttaggtttaccccttgcaacccgaatggtgcatcgccattcatgtgattagtctaaacgcgcatcactggcttgctctttactgtgcggggcttcgccctaccatcgctgttacggtttagtttccatgaaactaacgagcgatggtagggcggccccgctcgagttgagcaatccagtccgaagaggtttacgaagaggcgctgaactgaccg

SEQ ID NO: 18632 - RNA, 222 nt, unidentified
  source 1..222: mol_type = other RNA; note = Blastocatellia bacterium; note = Related to JADJPF010000004.1
gtgcaaaagtaaagaacttaccttgcaacccgaatggtggatcgccattcttgtactcagtctagtcacgcttcactagtctgctctttacttttgccggtgctaaccaccggcgggtattccggtttgtgtttcgtaaagtgaataacccgccggtggttgcaccggcatcgagttgagcaagcctagtctttagaactttacgaaggttttgcttttgca

SEQ ID NO: 18633 - RNA, 224 nt, unidentified
  source 1..224: mol_type = other RNA; note = Acidobacteria bacterium; note = Related to JACQZQ010000027.1
tggctaaaatgaaggcttttccttgcaatctggaaggtggatcgctttccttgtcggtagttctgtcatgcttcactagtctgctcttcactattgcccgagctaaggccaggcgcggatttcggtgaggattttataaatctaaatccgcgcctggccttgctcgggcatcgagttgagcaagcctagtccttagaacttttcgaaggtcactcattttagcc

SEQ ID NO: 18634 - RNA, 222 nt, unidentified
  source 1..222: mol_type = other RNA; note = Related to JAIBAN010000080.1; note = Blastocatellia bacterium
ctcctggaccctgaaaaaacccttgcaatccgggcggtggatcgccgcccttgcacatagcctgagcacgcgtcaccggcctgctcgtcactttgcttcacaggacctggtatcgaaattccggtgtggctttcgacaaccaaatgttcaataccaggtcccgtgaagctttagttgagcaagtccggtcctgagagttttcgaaggtatccggttacaggc

SEQ ID NO: 18635 - RNA, 223 nt, unidentified
  source 1..223: mol_type = other RNA; note = Acidobacteria bacterium; note = Related to JACQXX010000070.1
ccaagaaccaaccagattttccttgcaacccggacggtggatcgccgtccttgcgcgcagtttgaaccagcatcactggtctgctcttcactttgcaccctaatgtgctaatagcccaatcccggtttggatgtcccacatcaaatgtgggctattagcacatgggtgcttgagttgagcaagcccagtcctgagaggttttcgaaggaaactggaatttttc

SEQ ID NO: 18636 - RNA, 222 nt, unidentified
  source 1..222: mol_type = other RNA; note = Acidobacteria bacterium; note = Related to JAFDVL010000054.1
cggtcaagcgtgaccaccagccttgcaaaccggacggtggatcgccgtccttgcgctcagttgatgcacgcatcactggcctgctcttgactatgcaagactgcactagctattgctatttcggtgtgtttttcgccaaaagaatgagcaatagctagtgcgtcttgctcgagttgagcaatccagtcctgagagattaacgaaggagtgtcgcggttgact

SEQ ID NO: 18637 - RNA, 219 nt, unidentified
  source 1..219: mol_type = other RNA; note = Acidobacteria bacterium; note = Related to JAFAZX010000026.1
cagggcacgcacgcgggccttgcaacccggacggtggatcgccgtccatgcgcaaagctagggcacgcgtcactggcccgctcttaactgtgcgtagcacgcctgctagcggtattccggattggcttccatgaagcgaatgaccgctagcaggcgtgctacgctcgagttgagcgacccagtcctcaggagttttcgaaggggacgcgggcgcgccct

SEQ ID NO: 18638 - RNA, 222 nt, unidentified
  source 1..222: mol_type = other RNA; note = Acidobacteria bacterium; note = Related to JABFSD010000364.1
gcggccagccactacagaccttgcaacccggtcggtggatcgccgcccatgtgtttagctttgtcacgcttcactggctcgctcttaactgtgcgggtctgcctaccctcacgctattgcggtttgtattccgcgaacaaaatgagcgcgagggtaggcgccccgctggagttgagcgatccagtcctaagaccttttcgaaggaaacaacgtggctggccg

SEQ ID NO: 18639 - RNA, 217 nt, unidentified
  source 1..217: mol_type = other RNA; note = Related to JAFDVJ010000081.1; note = Acidobacteria bacterium
tcgaaaaaacgctctgggacttgcaaaccggacggtgcgatcgccgtccctgccgcttgactgaacacgcttcaccggcttgttcttaacttcggcgaaattccactcctgtcgctgtttcggtcggtattccgcgaataaaactagcgacaggagtagaatttcgcttgagttgaacaatccggtccttcgatttcacgaagacgcgcgtttttcg

SEQ ID NO: 18640 - RNA, 222 nt, unidentified
  source 1..222: mol_type = other RNA; note = Pyrinomonadaceae bacterium; note = Related to JAIBCC010000010.1
tttcggcgtttgccgagacatcttgcaaccggagcgatgtttcgtcgttcaagcgcacagattaactacgcatcacgggcttgttctttactgtgcgagtcaatgtcctagtagtgcaatttcggtttgaaatccgagatttaaatttgcactactaggacagactcgctggagttgaacaatcacgtcctttgtttattacgaagatcagcaaacgtcgaa

SEQ ID NO: 18641 - RNA, 220 nt, unidentified
  source 1..220: mol_type = other RNA; note = Related to NZ_JAFREP010000006.1; note = Acanthopleuribacter pedis
acgacggtgacgatccgtcttgcaatctggatggcggatcgccatccgtgcttgttggtttgtcacgcttcaccgactcgatcttcactgtgcggaattcacgctatgttcgccaggccggtacgggttccctgaacctcctggtcgaacatagcgcgattccgcgtcgagttgatcgattcggtctcgggaattcatcgaagatggatcgtcgccgtcg

SEQ ID NO: 18642 - RNA, 218 nt, unidentified
  source 1..218: mol_type = other RNA; note = Related to NZ_CP071793.1; note = Proposed Sulfidibacter corallicola
cggcggtgattgtcggctttgcaacccgggtggcgtttcgccatccatgcaacctgatctgtcacgcatcaccggctcgatcttcactgtgcggaactcgctatgtcagtgccaggtcggtttggattccctgaaccacctggtcaccgacatagcggttccgcgtcgagttgatcgatccggtctcgagattctctcgaaggtcgacagtcgccgcc

SEQ ID NO: 18643 - RNA, 221 nt, unidentified
  source 1..221: mol_type = other RNA; note = Acidobacteria bacterium; note = Related to JAGNHB010000094.1
gcgatggtggctcttttcccttgcaacccgggcggtggatcgccgtccatgtccgcagctgaagcacgcgtcactggccagctcttcactttgcgggtctcgccaccggtgggcaattacggtgtgaattccgtgaatttaattcgcccaccggtggcggacccgcttcgagttgatcagtccagtcccgagacgtttccgaaggaacccgactgccatcg

SEQ ID NO: 18644 - RNA, 218 nt, unidentified; identical to SEQ ID NO: 18642
  source 1..218: mol_type = other RNA; note = Proposed Sulfidibacter corallicola; note = Related to NZ_CP071793.1

SEQ ID NO: 18645 - RNA, 225 nt, unidentified
  source 1..225: mol_type = other RNA; note = Deltaproteobacteria bacterium; note = Related to JACKEM010000004.1
gggagacgcttcgagaaggaccttgcattaggggcggtggatcgccgtccaagcgaaatggcttctcttgcgtcactggtctgctcgtgactgtcgggattgcccaccggtccgttggtcccaagggggatcggcgtcgatcgaacgcaacgcaccggtgggcatcccttgtgagttgagcagtccagtcaggtgttaggacgaaggggtcttcgaagcgtctcc

SEQ ID NO: 18646 - RNA, 221 nt, unidentified
  source 1..221: mol_type = other RNA; note = Related to JAGQSB010000027.1; note = Acidobacteria bacterium
agcagcagtgggttccttccttgcaacccgggcggtggatcgccgtccatgtcaacaggcttcccatgcatcacgagcccgctctttactgtgcgaattacgcccaccacgctccattacggtatgaattccgtgaatttaatgaagcgtggtgggcaaattcgcgtcgagttgagcggtctcgtcccaagatgttttcgaagattcgaatccactgctgc

SEQ ID NO: 18647 - RNA, 222 nt, unidentified
  source 1..222: mol_type = other RNA; note = Related to JAHBVW010000058.1; note = Deltaproteobacteria bacterium
gcgtgacgggtggccttggaccttgcaacccgggcggcggatcgccgtccatgcggtcagctcgtgcgtgcctcactggctcgctcaagactgtgcgcacgtcgactcccccaaaggattccggtggggatttcgagaaatcgaatgccctcgggggagtcgacgtgcgctcgagcaaagcaatccagtcccgagagtagacgaaggtagccacccgtcacg

SEQ ID NO: 18648 - RNA, 220 nt, unidentified
  source 1..220: mol_type = other RNA; note = Related to JABFXX010000347.1; note = Kofleriaceae bacterium
gcgtggcgcgtggtcctagaccttgcaatcgggcggcggatcgccgtccttgcgttgatcccgcgcatacctcactggctcactcaatactgtgtgtccgcagtgcaccccaggagattccgagggggtttcgtgaaagcgaatgcacccggggtgcaccgcggccactcgagccgagcgatccagtcccaggcgtagacgaaggtaactacgcgccacg

SEQ ID NO: 18649 - RNA, 226 nt, unidentified
  source 1..226: mol_type = other RNA; note = Related to JAGPDK010000426.1; note = Kofleriaceae bacterium
gcgtggcgggtgagatacgaaccttgcaatctggttggcggatcgccaaccttgcggtcacgtaccccatccatcactggctcgctcaatactgtgtgccgacggcatggtgcagtcgattctcaagcggattcccgatgggaatcgaatgcaaccgcaccataccgtcggcactcgagccgagacgatccagtcccaggagtgaacgaaggtctcacccgccacg

SEQ ID NO: 18650 - RNA, 221 nt, unidentified
  source 1..221: mol_type = other RNA; note = Related to JABFRG010000606.1; note = Polyangiaceae bacterium
agagcgcgcgcggggcctgatcttgcaaaccgggcggcggatcgccgtccttgcagcctggccttccatgcttcactggctcgctcttgactgtgcgattaagacccaccacatcgaattccgggttcaatccggcagattcaatgtcgacgtggtgggtctcatcgcttgagttgagacgatccagtcccgagatctacgaagtgcctccgcgcgcgctc

SEQ ID NO: 18651 - RNA, 193 nt, unidentified
  source 1..193: mol_type = other RNA; note = Related to JAGQIK010000716.1; note = Myxococcales bacterium
catcctttgctttatgggcggcggatcgccgtcctagcgaaatggttgtccacgtttcactagctcgctcttaacgatgccggggctgccctgctgtcgctatcgcgagtgtcttccgcgaagacgatgagccgacagcagggcgccccggcttgagttgagcgatctagtcctgggagtctctcgaagggat

SEQ ID NO: 18652 - RNA, 209 nt, unidentified
  source 1..209: mol_type = other RNA; note = Related to JAFCZD010000018.1; note = Deltaproteobacteria bacterium
aagtcagacgactttgcattctgggcggtggatcgccgtctttgccgagtggtttttcatgcttcactagctcgctcttaactgtgccggtactgccctggtagtgctatcggcggttggattccgtgaatccgatgagccactaccagggcgtaccggctggagttgagacgatctagtcccgggcgtctttcgaaggaactctgacc

SEQ ID NO: 18653 - RNA, 223 nt, unidentified
  source 1..223: mol_type = other RNA; note = Myxococcales bacterium; note = Related to JAEUJZ010000010.1
gggatgagcgagagactcttcttgcaaccgggcggtggatcgccgtccatgcagcatggctgttcatgcatcactggtctgctctttactgtgcggccctgggcctgatgtccaaattgcaggttggttttcggaaaaccaatgttcgacatcaggcccgtgccgctcgagttgagacagcccagtcccaagaggtcttcgaagtcagctctcttgctctccc

SEQ ID NO: 18654 - RNA, 220 nt, unidentified
  source 1..220: mol_type = other RNA; note = Related to AFWT01000002.1; note = Thiorhodococcus sp.
tcggaagcggactcatcctttgcattctgggcggcggatcgccgtctttgccaagtggttattcatgcgtcactagctcgctcttaactgtggcgatactgccccctaggtgcctttgccggttgaatcccttggattcaaaggtgcacctagggggcgtatcgcctggagttgagacgatctagtcctgagtcattcgaaaggactccgcgccgctccg

SEQ ID NO: 18655 - RNA, 220 nt, unidentified
  source 1..220: mol_type = other RNA; note = Related to JAEUKG010000966.1; note = Myxococcales bacterium
gagacggctggcggggcgatcttgcaacctgggcggtggatcgccgtccatgcaacctggcccgtcatgcatcactggcccgatctttactgtgcgggacacagggtgctgtagggattccggtgggaatcctgggagattggatgccccacagcaccccggtcccgcttgagttgatcgagccagtccctcgtgggttcgaagaccccgtcggccgtct

SEQ ID NO: 18656 - RNA, 222 nt, unidentified
  source 1..222: mol_type = other RNA; note = Related to JAESTW010000014.1; note = Kofleriaceae bacterium
gcagcgatatagatccataaaccttgcagtatgggcggcggatcgccgtccttgtgaattggcctgtcatgcatcactagctcgctcgtgactttgccggggaagcctccctcgacgttcttcggtgtgatttgccgagaatataagaacgtcgagggaggctccccggccggagttgagacgatctagtcctgagagttgtacgaaggtatctaatcgctg

SEQ ID NO: 18657 - RNA, 222 nt, unidentified
  source 1..222: mol_type = other RNA; note = Related to NZ_JAHXBG010000009.1; note = Cystobacter gracilis
cggcggtcagagggcggtaccttgcaacccggacggcgtttcgccgtccttgcctgatggcctgtgatgcatcactggcccgctcttgactgtgccgtacctccctaccccaggcgtatggcggtttggattccgtaaatccatagcgcccggggtagggggtacggcttgagtcgagacgagccagtcctgagagcagtacgaaggtgctctcggaccgcc

SEQ ID NO: 18658 - RNA, 222 nt, unidentified
  source 1..222: mol_type = other RNA; note = Myxococcaceae bacterium; note = Related to JAFGNZ010000091.1
cggcggtcagagggcagtaccttgcaacccgggcggcgtttcgccgtccttgcctcctggcctgtgatgcttcactggcccgctcttgactgtgccgtgtctccctaccacgtgcgtatggcggtgtggattccgtaaatccatatcgcacgtggtaggggccacggcttgagtagagacgagccagtcctgagagctgtacgaaggtgctcttggaccgcc

SEQ ID NO: 18659 - RNA, 221 nt, unidentified
  source 1..221: mol_type = other RNA; note = Related to NZ_JADWYI010000001.1; note = Archangium sp.
cggcggtcagggggctgttccttgcaatccgggcggtgtttcgccgtccatgcctcatggcctgtcatgcatcactggcccgctcttcactgtgcgggtcctccctccctgtagcggcggcggtgtcaaccgcgtcggttccgcgcgccacagggagggggacccgctggagttgagacggtccagtcccgagagcggttcgaaggtgctcccggaccgcc

SEQ ID NO: 18660 - RNA, 220 nt, unidentified
  source 1..220: mol_type = other RNA; note = Myxococcales bacterium; note = Related to JADIZX010000005.1
cggcggtcttcggggtgacatcttgcaacacgggcggcgtttcgccgtccatgcgacctggccctccatgcgtcactggcccgctctcgactgtgcggacgacgcctagctggtgctgttccggggtcaatcccgagaattcaacgagcaccagctaggcgcgtccgcttgagttgagcgagccagtcccgagacatcttcgaaggtccccgaagccgcc

SEQ ID NO: 18661 - RNA, 220 nt, unidentified
  source 1..220: mol_type = other RNA; note = Related to JADJQX010000001.1; note = Myxococcales bacterium
cggcggacttcggggtcacatcttgcaaaccgggcggtgtttcgccgtccatgcaacctggccctccatgcgtcactggcccgctctcgactgtgcgtccgatgcctagctagtgctgttccgggttcaatcccgcatattcaacgagcaccagctaggcacggccgcttgagttgagcgagccagtcccgagacatcttcgaaggcccccgaatccgcc

SEQ ID NO: 18662 - RNA, 221 nt, unidentified
  source 1..221: mol_type = other RNA; note = Related to JAIOQA010000029.1; note = Deltaproteobacteria bacterium
cgcgacgacggagcactggaccttgcaaccgggcggcgtttcgccgtccatgcgacctggcccctcatgcgtcactggctcgctcgtgactgtgcgagggctgccaccacgcgtcgataccgagtggcatctcgcagatgtcatgcgacgcgtggtggcgccctcgctcgagttgagacgatccagtcctgagagctgtacgaaggttgctccgtcgttgc

SEQ ID NO: 18663 - RNA, 222 nt, unidentified
  source 1..222: mol_type = other RNA; note = Related to JAGPCY010000008.1; note = Kofleriaceae bacterium
gcggagcgatcaggcggcacatcttgcaacccggacggtggatcgccgtccctgcaacctggcctggcacgcatcactggcccgttcttgactgtgcgacgtctgccacccctgcgggataccggtgtcaatcccgcgtattccatacccgcaggggtggcgacgtcgcttgagttgaccgagccagtcggaagagtgttcgaaggaccgcctgacgctccg

SEQ ID NO: 18664 - RNA, 223 nt, unidentified
  source 1..223: mol_type = other RNA; note = Related to NZ_NETK01000001.1; note = Nannocystis exedens
tgacaacggcgaaggccgagcctagcaacccgggcggcggatcgccgtccttgcgaaatgctcgttcacgcttcactggcccgctcttgactgtgcggcccatcgggtagctgtcgctattccggtgtgacttccatgaagcgactgagcgacagctacccggggccgcttgagttgagcggtccagtcctttgagccttcgtagcgggtcttcgccgttgtc

SEQ ID NO: 18665 - RNA, 221 nt, unidentified
  source 1..221: mol_type = other RNA; note = Related to JAEUJW010000075.1; note = Myxococcales bacterium
cgacaacggcaagtgcatagccttgcaacccgggcggcggatcgccgtccatgcaaacagctcatacacgcttcactggcccgctcttgactgtgcggtacatcgggtagcagcggctattccggtgtggcttccgagaagcgaatgagccgctgctacccggtaccgcttgagttgagcggtccagtcctgagagccttcgaagggcactcgccgttgtc

SEQ ID NO: 18666 - RNA, 220 nt, unidentified
  source 1..220: mol_type = other RNA; note = Related to JADKFZ010000012.1; note = Nannocystis sp.
cgacaacgacgagggcaagccttgcaacccgggcggcggatcgccgtccttgttccatgctcatccacgcttcactggcccgctcttgactgtgcggtacatcgggtagcagcggctattccggtgtggcttccgagaagcgaatgagccgctgctacccggtaccgctggagttgagcggtccagtcctgagagccttcgaagggccctcgtcgttgtc

SEQ ID NO: 18667 - RNA, 219 nt, unidentified
  source 1..219: mol_type = other RNA; note = Myxococcales bacterium; note = Related to JAGQIT010000589.1
gcggcgcgaggtgaccaggccttgcaacccgggcggcggatcgccgtccatgccgcatgacaatgcacgcatcactggtctgctcgttactttgcggtacctcggggtagtgtcgctattcctgtagggattccgtgaaccgaatgagcgacactaccccgggtaccgcttgagttgatcagcccagtcctggggagccttcgaaggcgccgagcgtcg

SEQ ID NO: 18668 - RNA, 222 nt, unidentified
  source 1..222: mol_type = other RNA; note = Related to JACKDU010000005.1; note = Myxococcales bacterium
cagcggcgcgaggagccaggccttgcaacctgggcggcggatcgccgtccttgccgcatgacaatgcacgcatcactggtctgctcgttactgtgcggtacctcggggtagtgtcgctattccggtgagggtcccgcgaaccgaatgagcgacactaccccgggtaccgcttgagttgaccagcccagtcccggggagccttcgaaggcgccagacgccgct

SEQ ID NO: 18669 - RNA, 225 nt, unidentified
  source 1..225: mol_type = other RNA; note = Related to JACKDW010000029.1; note = Myxococcales bacterium
cagcggcggtggtgaaccagccttgcaaaccgggcggcggatcgccgtccatgcacacagctcagccacgcgtcactggtccgctctttactgtgcggtaccatcgggtagtcgtgcttttccggtgcgacttcggagaagtgaataagcacgactacccgacgtaccgcttgagttgagcggcccagtcctgaggagccttcgaagggactcgcccccgtcgcc

SEQ ID NO: 18670 - RNA, 219 nt, unidentified
  source 1..219: mol_type = other RNA; note = Planctomycetaceae bacterium; note = Related to JAGQQQ010000127.1
cggaagcacgagtgagccttgcaacttgggcggcgtatcgccgttcgtgtcaattggttgaaactgcgtcactggtccgctcttgactgtgccattctcgcaccagtacggcgtttgcggtgcgaatccgttggattcaaactgccgtactggtgcggaatggcttgagttgagcggcccagtcctcagagcctttcgaagggaaactcgcctgctccg

SEQ ID NO: 18671 - RNA, 220 nt, unidentified
  source 1..220: mol_type = other RNA; note = Planctomycetaceae bacterium; note = Related to DLZC01000224.1
tggcggtcctgcagtgagccttgcaacccgggcggtggatcgccgtccatgcaacctgctttgaaccgcgtcactggtccgctcgtgactttgccggacatcacacctgtacgtcgattccggtgtggattccgcgaatcgaattcaacgtacaggtgtggcccggcttgagttgagcgacccagtcctgagagcctttcgaagggaatctgcagccgcc

SEQ ID NO: 18672 - RNA, 221 nt, unidentified
  source 1..221: mol_type = other RNA; note = Related to NZ_CP036281.1; note = Polystyrenella longa
agcagccggtgaagtgagccttgcaacccgaatggtggatcgccattcatgtgaattgataggaaccgcatcactggcccactcgtgactgtgcgggctgtcacctagtaacggtaattgcagtgtgaatcccctggattcaattgaccgttactaggtggcccgcttgagttgagcggtccagtcctgagagcctttcgaagggaagtcttaccggctgt

SEQ ID NO: 18673 - RNA, 219 nt, unidentified
  source 1..219: mol_type = other RNA; note = Candidatus Nealsonbacteria bacterium; note = Related to JABMRB010000852.1
ggaccggtcgagcgagccttgcaatccgggtggcggatcgccatccatgtgaaacgaattggaccgcatcactggcccgctcttgactgtgcggactacgccaccggtgcccgtttgctgtgcgagtcccaaggactcaaacagggcaccggtggcagtccgcttgagttgagacggtccagtcctcagagcctttcgaagggaaatgctcgtccggcc

SEQ ID NO: 18674 - RNA, 223 nt, unidentified
  source 1..223: mol_type = other RNA; note = Related to NZ_CP036433.1; note = Lignipirellula cremea
agacggcggttgcgagcgagccttgcaacccgggcggcgtatcgccgtccttgccaaatgatagagaccgcatcactggcccgctcttgactgtgcggaacatgcccacgggacgccatttacggtgcgtgccccgtgggcataaatagcgtcccgtgggcgttccgcttgagttgagacggtccagtcctgagagcctttcgaagggagctcctccgccgtc

SEQ ID NO: 18675 - RNA, 226 nt, unidentified
  source 1..226: mol_type = other RNA; note = Myxococcales bacterium; note = Related to JAHQVJ010000249.1
ctgaggtgggcagcgcacgccttgcaacccgggcggtgtcatcgccgtccatgcgcacagctgtgctctgcctcactggtccgatctccactatgcgctatagggccccctgccggcggcagcgatgggcctcgtgctcgaggtgccgcccggtagggggcccaatagcgcgtcgagttgatcgacccagtctccagcgagagcgaagacctcgctgcccatctca

SEQ ID NO: 18676 - RNA, 229 nt, unidentified
  source 1..229: mol_type = other RNA; note = Myxococcota bacterium; note = Related to JAHJCH010000337.1
agggtgcggtcgaggcaaagcttgcagtggggcggtggatcgccgtccatgcaccttgaccgagcatgcgtcactggcctgctcttcactggtaggccccagtatgggctagtccgtatttggcggtgcgttgtctgccgacaacaattacggactagcccataggggccttaattgagttgagacagtccagtctccgacgagaacttcgaagttttcggccgcgccc

SEQ ID NO: 18677 - RNA, 219 nt, unidentified
  source 1..219: mol_type = other RNA; note = Related to NZ_CP042468.1; note = Persicimonas caeni
cagcagtgagagggcagcaccttgcatcatgagcggcgattcgccgttcgcgatcaaagccctacaacgcgtcactgactcgctcgtgactgtgcggcctaaccctccccgggcgccgctccagtccggcttcggtgaagcgagcggcgcccggggagggtggccgcttgagttgagcgatccagtcaacagactggcacgaaggtccctctcactgct

SEQ ID NO: 18678 - RNA, 219 nt, unidentified
  source 1..219: mol_type = other RNA; note = Related to NZ_JAFREP010000009.1; note = Acanthopleuribacter pedis
cccccacgggtcgtgctcaccttgcaacccgaatggtgtttcgccattcatgcgctcagacccaccatgcatgcccggtcggcgcgtggcgcgacgtcgcctgtaccgcccgcgacattacggttcgaattccgagaacctaatgcgcgcggacggcgggtcgacgtcggcgccgtaccgcccggcaggatctagttcacgaagggacgacccatgggg

SEQ ID NO: 18679 - RNA, 232 nt, unidentified
  source 1..232: mol_type = other RNA; note = Related to SECR01000885.1; note = Myxococcales bacterium
ctgcgcagcgacggtcacgtcttgcaacccgggcggtgcatcgccgcccttgcatcctggtttcccgtgcatccctggcccgctcttcactgtgctaggccgctagccgtccgcgagatgcggtggccacagcgtgctacgcacaccgtgatctgcgcggacggctagcggcctagcttgagttgatcgagccaggcccgagcgtcttacgaagcacgaccgtcgctgcgca

SEQ ID NO: 18680 - RNA, 216 nt, unidentified
  source 1..216: mol_type = other RNA; note = Bacteroidetes bacterium; note = Related to JAGQVA010000789.1
atggaaagagggtgcaaagatcttgcatttggaatggtggatcgccattcgcgcatgctggtttggacagcgtcacaggccagttctttactttgcaaatagacaccctatacgtcacttccggtgtgacttccaggaagtgaagtaacgtatagggtatcatttgcttgagttgaactctcctgaaataaggaagtacgaagtaaccctcttcca

SEQ ID NO: 18681 - RNA, 219 nt, unidentified
  source 1..219: mol_type = other RNA; note = Related to JAFEUL010000003.1; note = Actibacterium sp.
agaaggcgcatggcggctttgcttattggatggtgtttcgccatcccggcctattgactgctcatgcatcgctggcgcgctctctatttgggcaccccagccccaccatgcgctttgctgtatgacttccgtgaagtcaaagacgcatggtggggcggggtgccctcgagttgagcgttccagcgctgggacttgttcgaaagtccggcatgcgctttt

SEQ ID NO: 18682 - RNA, 222 nt, unidentified
  source 1..222: mol_type = other RNA; note = Related to JAKRGB010000012.1; note = Ruegeria sp.
aaagcaagaggctgggagccttgcatcttgggcggtgtttcgccgtccgcgccaaccgactgtacatgcgtcgctggctcaatcttcacaacgcgaccccagccacccctatgcgcttgccgtttgagttcgcagaactcaaggcgcataggggtggcggggtcgctgggagttgatcgatccagccctgagagctgttcgaaggcaccagtcctcttgctt

SEQ ID NO: 18683 - RNA, 247 nt, unidentified
  source 1..247: mol_type = other RNA; note = Proteobacteria bacterium; note = Related to PBMT01000060.1
atggcttgcaacccgagcggtgtttcgccgttcttgcacactgttctttcatagaaactggaaacgactctatatagagcctcttgcagcgctgtgcagggcgggggccggcatctatcaatcggtatagcaattttccttcgaaacgaaggtagaccgatcaatagatgccggcccccgccctgcacagcgctgcaagaggctgatcgagttgtcgcctccagtgacaaagcttgacgaagccaca

SEQ ID NO: 18684 - RNA, 235 nt, unidentified
  source 1..235: mol_type = other RNA; note = Related to NZ_JADPIB010000005.1; note = Aureivirga marina
agagattttgttagcataaatactatggtgtttcgccatggttggagtaaagttctaattacatcactacacgtcaatgacattcagcgtgactcttaggtactataacgtactattgtaccttgtaatgctgagattcattgacattccttaaggtacaatagtacgttatagtacccccgtcacgcctacagtgattgaaggtagtacttggaaagattttgtaacaaaattc

SEQ ID NO: 18685 - RNA, 253 nt, unidentified
  source 1..253: mol_type = other RNA; note = Related to NZ_CP048222.1; note = Rhodocytophaga sp.
ttgttgaaaatataagtttttgttagcataaatgctgcggtgtttcgccgtggttgtagttaagctattcatacttcattacacattcatgccattcagcgtgctcctctacccatgggtagtaattcgttagaaaatcgctgaataagcagtggctcaattggtctagactaattactacccatgggtagctccacccgcttacagtaatgaaagataatcctgtgcagagttagtaacaaaaatttcaaca

SEQ ID NO: 18686 - RNA, 242 nt, unidentified
  source 1..242: mol_type = other RNA; note = Rhodospirillaceae bacterium; note = Related to JABHVB010000067.1
ttgcggcgcaggtttgttcctagcaaaaatgccgcggcgtttcgccgtggttgtagtaaagccggtgatacgtcatcggataccaatgtcactcagcccacgtagcgggaacgggcccttcccgcatcacgctgaggcgacttcaaggaagtccatgatgtgggacgagccctttcccgctacgtgggcctacagcgatcggcaccgatcgttgagagatggtaggagcaacctgcgccgcg

SEQ ID NO: 18687 - RNA, 229 nt, unidentified
  source 1..229: mol_type = other RNA; note = Cyanobacteria bacterium K_DeepCast_35m_m1_288; note = Related to VGQQ01000059.1
aggttcaggctcctcctagcaataacgccccggtgcttcgccggggcagcgttcacgcctctcatccaccatcggctgccgatgtcactcagcggccccggccttcccggccgggaacgcttcgctgagccgactgcaggcagtcacaacgcgttcccggccgggaaggccggggccgcctacagcgatcgacaccgatctcagctggatagtaggaagagcctgcacc

SEQ ID NO: 18688 - RNA, 230 nt, unidentified
  source 1..230: mol_type = other RNA; note = Related to JABMNF010000410.1
tgagtgtatggtcttcctagcaattcgcctcggtgcttcgccgaggtagcgttcacgtctctcatccaccatcggctgccgatgtcattcagcggcaacgggccaaaatgcccggagcgcttcgctgaatcgactgcaagcagtcacttttgcgctccgggcgttttggcccgccgccgcctacagcgatcgtcaccgatctcagctggatagtaggaagatctgcgctc

SEQ ID NO: 18689 - RNA, 225 nt, unidentified
  source 1..225: mol_type = other RNA; note = Related to AE017126.1; note = Prochlorococcus marinus
aggcaggctgttctagcaattaaaccttggcgtttcgccaaggcagtagttaagctacaaaaccatcatcggctgacgatgtctctcagcatctagctgcttaggccggcctaaacctttctctgaaacgactctacgagtccttcaaagtttaggccggcctaagccgctagacgcctacagtgatcgacaccgatcatagatagggcagtagaacagcctcca

SEQ ID NO: 18690 - RNA, 239 nt, unidentified
  source 1..239: mol_type = other RNA; note = Related to NZ_NIGF01000009.1; note = Abditibacterium utsteinense
ccaatgcccgatgcgtggtgccagccttttatctgcgatgtttcgtcgcggtggccgtcaagctctcatcacatcaccggcacgccgtcgcgttttcgcgtcagtgcgtagtagtgcggttcctgtctcggcgctgagagagacaagctcaccggccaggaaccgcactactacgcactgacgctacagtggacggcgccggtcgcttcgctgttaagtggcatttcgcgcgggcattg

SEQ ID NO: 18691 - RNA, 233 nt, unidentified
  source 1..233: mol_type = other RNA; note = Related to AP024152.1; note = Abditibacteriota bacterium
cagccaatgccgaaaggcggccagcatctttgcgatgtttcgtcgcggaagcgttcacgccacctttccatcaccggagcgccgtcgtgttttcgcgctaggcgcgtactagtgcgggagaccgagtcgcggattggggcaagcccaccacgatctcccgcactagtacgcgcctagcgctacagtggacggagccggtcaagtctgtaaagtggccgctttgggcgttggct

SEQ ID NO: 18692 - RNA, 235 nt, unidentified
  source 1..235: mol_type = other RNA; note = Abitibacteriaceae bacterium; note = Related to JAFAZH010000051.1
accttgaggcagctcatttccggcaatttgtccccggcgtttcgccgtggccgtcgtatcgctcgtcatccttcacgggccgccagtgtgatttcacccgctgcgcaccggtaggttgcttgatttcccgctgaagcagcgtagctcaggccatcaagcaacctaccggtgcgcagcgggttacagtgactggcgcccgtcccctctgtttagcggcaatgtagatgcttcaagg

SEQ ID NO: 18693 - RNA, 201 nt, unidentified
  source 1..201: mol_type = other RNA; note = Cytophagales bacterium; note = Related to JACMJB010000482.1
aagccgtaccggacgaaacagcgtcacttacccctcgggaccggcgtcggccactgtaggcgcagtaccgtacaccagtggccggtcgtgtcgtgggccaccgccgaatcagcgcatacgaccggccactggtgtacggtactgcgcctacagtggccgacgccggtccctgggaggtacgtagcgtcgctcaccccgctc

SEQ ID NO: 18694 - RNA, 250 nt, unidentified
  source 1..250: mol_type = other RNA; note = Related to NZ_JACHGW010000004.1; note = Armatimonas rosea
gtggagggcggagctaaaatcgttagcctttcaagccttcgggtttgagccacgatgcttcgtcgtggtggccgtaaagctcgctttacatcaccggtcgccgatgcgactcagcgcaggccgcactagtggcggtctaccgttcgcgctgaggagcctgcggccacgccccgtagaccgccactagtgcggcctgcgcctacagtgatcgtcgccggtccctgcaggatagtagcgattccgccctcca

SEQ ID NO: 18695 - RNA, 232 nt, unidentified
  source 1..232: mol_type = other RNA; note = Related to NZ_BHFQ01000005.1; note = Capsulimonas corticalis
gtttcgggagcggtgtggttagcaattcgtctgcggcgtttcgccgcggctgccgtgaagatggcttcacttcaccggtcaccgtttctactcagcccggcgacggggtagtgcacccctctgccggcgctgagtcggacgtggcccaccaacagaggggtgcactaccccgtcgccgggcctacagtgaacggcgccggtcctccgtgtcaagtagccgtcgctcccgaaa

SEQ ID NO: 18696 - RNA, 233 nt, unidentified; identical to SEQ ID NO: 18691
  source 1..233: mol_type = other RNA; note = Related to AP024152.1; note = Abditibacteriota bacterium

SEQ ID NO: 18697 - RNA, 226 nt, unidentified
  source 1..226: mol_type = other RNA; note = Related to NZ_PZZP01000001.1; note = Desmospora activa
acgaattctactttgtctagctgattgtgcggtgtaccgccgcacatgccgtgatgtgtcacattcatcacccggctccgcgcgacttggcaggcctaatgcggggatacccccctttttcgcctactagtcaagcgtagctacggccaaaaaggggggtatccccgcaggcctgttcagtggcgaagccagctcctatgagttgtagtggacgaagtcgatttcc

SEQ ID NO: 18698 - RNA, 225 nt, unidentified
  source 1..225: mol_type = other RNA; note = Related to NZ_FXTI01000004.1; note = Melghirimyces algeriensis
gatgagatgtttgttcagcaaccctgcatggcgtaccgccatgtgtgacgtgatgtgagagattcatcacccggctccgcgcgacttggcaggcccaaagcatcaggggtacctgttaaggagcccctaaacaggcgtagccgctgctcctcaacaggtacccctgatgcgggcctgtacagtggcgaagccaactcctgagatctgtagtgaacaaacactcaa

SEQ ID NO: 18699 - RNA, 234 nt, unidentified
  source 1..234: mol_type = other RNA; note = Related to QJKK01000010.1; note = Thermoflavimicrobium daqui
gttcagcaaagagtgacttgtctagccattagcatggtgttacaccatgtatgcaataatgtctcacattcgtcactcggctccgcgctacttaggcaggcctcctatatggggtactagtttgataggtcgcctaaggaggcgtagccgctcctatcaactagtaccccatatagggtcctgttcagtggcgaaaccaagttcgaagagtgttagtagacaagttgtgcaaaa

SEQ ID NO: 18700 - RNA, 213 nt, unidentified
  source 1..213: mol_type = other RNA; note = Related to NZ_FORR01000019.1; note = Thermoflavimicrobium dichotomicum
gtgacttgtctagcatctggcatggtgttacgccatgtatgcgtaaatgctgctcattcgtcactcggctccgcgctacttaggcccccgatagtaggggtacatcggtaatagaacacctaagtaggcgtagccgtgatctattcctgatgtacccctactatgggggtacagtggcgaagccaactcccaagagtggtagtagacaagtca

SEQ ID NO: 18701 - RNA, 220 nt, unidentified
  source 1..220: mol_type = other RNA; note = Related to NZ_FQVL01000006.1; note = Seinonella peptonophila
atagagatttatctagctgctaatatacggcgatacgctgtgtttgccttgacgtgaacaattcgtcacccggctccgcgctactttggcaggcccaatccacctggtacccccctggattagacctgagtaggcgtggccgtcatatccaggggggtaccaggtggggtcctgtacagtggcgtagccaactcaaggatttttagtagataaatttctg

SEQ ID NO: 18702 - RNA, 226 nt, unidentified; identical to SEQ ID NO: 18697
  source 1..226: mol_type = other RNA; note = Related to NZ_PZZP01000001.1; note = Desmospora activa

SEQ ID NO: 18703 - RNA, 213 nt, unidentified
  source 1..213: mol_type = other RNA; note = Related to NZ_CP048104.1; note = Kroppenstedtia pulmonis
aagcggtgttcagcaatctgtgcggtgttacgccgcgcttgcaggaacgtgtcacatccatcacccggctccgctctactttggcagggaataggggacctgtacccccttttgccagcctgagtaggcgtcgccactgacaaaagggggtacaggtcccctattccctgttcagtggcgtagccagctcccaagggtatagtggacaccgct

SEQ ID NO: 18704 - RNA, 230 nt, unidentified
  source 1..230: mol_type = other RNA; note = Related to NZ_LN812102.1; note = Risungbinella massiliensis
gttcggctatgaaagtctagcaactcgtacggcgttacgccgtgcatgctctcaagctgttttcacttcaaccggcactgcgctacttaggcagcacctatcgtctacgggggctacctgtagagatcctaagtaagcgtagctgctctctacaggtagcccccgtagacgggtgctgttcagtggcatcaccggttcggataggaagaaagtggacttacatagcagaa

SEQ ID NO: 18705 - RNA, 216 nt, unidentified
  source 1..216: mol_type = other RNA; note = Related to NZ_SLXV01000034.1; note = Baia soyae
taatacttgtctagcaattttgcatggtgttccgccatgtttgcagaaatgtcttctattcgtcaatcgatctcgcgttacttaggcagaactactaaataggggtacctgtttagctgtctaagtagccgcaggccacaactaaacaggtacccctatttagtagttctgttcagtacgagatccattccaaggtatttttagtagacaagtatt

SEQ ID NO: 18706 - RNA, 216 nt, unidentified
  source 1..216: mol_type = other RNA; note = Related to JAKWBN010000001.1; note = Shimazuella sp.
taaaagttatctagctttcttgtgtacggtgttacgccgtatctgcgtgtaagattcacatacttcatccggtcccgcgttactatactagccctaccgtggtggggggtgattgtggccgcctaaagaggcgtagccgctaccacaatcgaccccccaccacgggggctagctcagtggcgttaccagatcatggtgttttcgtagataactttt

SEQ ID NO: 18707 - RNA, 217 nt, unidentified
  source 1..217: mol_type = other RNA; note = Related to NZ_ATZF01000012.1; note = Shimazuella kribbensis
tagaagttatctagctatcttgtgtacggtgttacgccgtatcagcgtgtaagattcccatacatcatccggtcccgcgttactatactagacctaccgggtaggggggtgatcgtgagttgcctaataaggcgtagccgcaactacgatcgacccccctacccggggtctagctcagtggcgttaccagatcatagtgttttcgtagataacttct

SEQ ID NO: 18708 - RNA, 222 nt, unidentified
  source 1..222: mol_type = other RNA; note = Related to JACXAG020000009.1; note = Hazenella sp.
tgagcatcattgatttagctttttgcatggcgatacgccatgcttgatgtgacgtatacaatccgtcacccgtctccgcttgattagtcaggatcccctactagagggtgcattctatcctgactaatgaggcgtagcctcggcaagaatgcaccctctagtaggggatcctgtccagtggcgaaaacgactccaaagtgttttagtaaatcaatgatgctc

SEQ ID NO: 18709 - RNA, 229 nt, unidentified
  source 1..229: mol_type = other RNA; note = Related to NZ_SMAG01000003.1; note = Hazenella coriacea
acatagagacttgttctagcattttgaacacggtgttacgccgtggctgcgttgatgactaacactcgtcacccggctccgcgcgactttggcaggcccttcccgataggtagggtgctaaattctgcctaagtaggcgcagccgcaagaatttagcaccctacctatcgggggtcctgttcagtggcgaatccagctcggagagtcttagtggaacaagttctcaacg

SEQ ID NO: 18710 - RNA, 218 nt, unidentified
  source 1..218: mol_type = other RNA; note = Related to NZ_BMEX01000001.1; note = Kroppenstedtia guangzhouensis
ccatccttgttcagcatgattgtatggcgttccgccatgcttgcgttgacggtaccaatccgtcacccggctccgccctacttggcagtcgggggtgtactaccacccgactcggctgcctaaaaaggcgtagccgcagcctcttttgtcgggtggtagtacacccccgactgttcagtggcgaaaccgactcgatggaattttagtgaacacggatg

SEQ ID NO: 18711 - RNA, 229 nt, unidentified
  source 1..229: mol_type = other RNA; note = Related to PVTZ01000010.1; note = Laceyella sediminis
acataaaataagactttgtctagccaattgcacagtgatacgctgtgcgggacatgatggcaaacaatcatcacccggctccgcgttacttagtcagccctagtgcaccccttagtgcgttaggttctgcctaagcaggcgtagccggacctaacgactaaggggtgcactagggctttttcagtgcaaacccagatccgaagactgttagtagacaaagtgattcatg

SEQ ID NO: 18712 - RNA, 218 nt, unidentified
  source 1..218: mol_type = other RNA; note = Related to NZ_CP034118.1; note = Staphylospora marina
atgactttgtctagcgaagcttcgcgcggcgatccgccgcgttcgacgtgaagtgtcctttcacttcacccggctccgcttgtcttggcaggcacaccacagctgacaccatttgtggcctgcctgggcaggcgtggccgcggccaaaatggtgccagctgtggtgtgcctgctccagtggcgcagccaggtcccaagggtgttggtggacaaagtcg

SEQ ID NO: 18713 - RNA, 221 nt, unidentified
  source 1..221: mol_type = other RNA; note = Related to NZ_CP036426.1; note = Tautonia plasticadhaerens
agggaggcagcggtcccattagccgatcgtgcggcgatacgccgcgcaggtccccgtgcccgacactcgtcacgcgcccgaccgccatctgcggccggggcaccgaccaggccctcgcctggttcggttgctccgcaacccgagggccccggtcggtgccccggccgctccagttggccggtcgcgtccgaaggatgttcgtagcgggaccgctgcctccc

SEQ ID NO: 18714 - RNA, 221 nt, unidentified
  source 1..221: mol_type = other RNA; note = Related to NZ_RYZH01000020.1; note = Tautonia sociabilis
agggaggcagcggtcccattagccaatcgtgcggcgatacgccgcgcaggtcaccgtgcccgtcattcgtcacgcgcccgcccgccgtctgcggccgggggaccgaccacggccgcagctgggtcggttgctccgcaacccgcggccggcggtcggtcccccggccgctccagttggccggtcgcgtccgaaggtcgttcgtagcgggaccgctgcctcct

SEQ ID NO: 18715 - RNA, 222 nt, unidentified
  source 1..222: mol_type = other RNA; note = Planctomycetaceae bacterium; note = Related to JAGQQD010000063.1
ggaatgggatggtggcaggattagccaattgttcggcgatacgccgagcgggtttccgtgcttgtcattcgtcacgtgtccgttcttcaccccgcgaccggcgtactacccggcccgcgctgggtggagtccacaggcctccgcgggcccacgggtagtacgccggtcgctttagtggaccgaacacgtcctcaggatgttcgtaaccccaccaagtcaccc

SEQ ID NO: 18716 - RNA, 225 nt, unidentified
  source 1..225: mol_type = other RNA; note = Related to JADJAE010000011.1; note = Deltaproteobacteria bacterium
ggacggggcgtggtgagtgacttagcaatctgtgcggcgttacgccgcgcttgtcgaagtgcccgccattcgtcacgagcccgttcatcacacgcgtaccccgacggtgcccggcagcgctctggttgggtgcctccggcaccgcgctgccatggcaccatcggggtacgctttaagtggaacggtcgcgtcccagggatgttcgtaagcccaccgcgccccgtc

SEQ ID NO: 18717 - RNA, 224 nt, unidentified
  source 1..224: mol_type = other RNA; note = Planctomycetia bacterium; note = Related to JAEUIF010001171.1
ggttcgagacagcggactagcttagccgtttgcacggcgttacgccgtgcgggtttccgtgccggtcattcgtcacgtgcccgttcggcacagcgcggcccccgcactagcaggggctcgcgctgggtcgggcccgccgggccccgcggctccctgctagtgcgggggccgcttcagtggaacgagcacgtccgcaggaggttcgtaaggccgctgtctcgact

SEQ ID NO: 18718 - RNA, 233 nt, unidentified
  source 1..233: mol_type = other RNA; note = Acidobacteria bacterium; note = Related to JADLFP010000276.1
ggggagccgggatcgcgtttctagccaagaaggtcatgccttccgtgcggtgtcacgccgcgcttgcccacgtgcccggcattcgtcacgcgcccgtttaccactcgctgccggcggcaccggtcggaccgctcctggatgggtcccgccgggacccgcggtcttcgaccggtgcgccggcgcttcagtcaaacgagcgcgtcccgtggaagttcgtaggacgcccggctccc

SEQ ID NO: 18719 - RNA, 222 nt, unidentified
  source 1..222: mol_type = other RNA; note = Related to MGST01000139.1; note = Deltaproteobacteria bacterium RIFOXYA12_FULL_58_15
tggacggtaggctcgtcgattagccatttgtgcggtgttacgccgtgctggccggaatgcttgtcattcgtcacgagcccgttcgtcacccgcggacaatggactggtgtgcccgcttgctgggtcgtgcccttcgggcaccgcgggctcacaccagtccattgtccgctttagtggaacggtcacgtcgtaggatgttcgtaaacgacgggcctgccgtcc

SEQ ID NO: 18720 - RNA, 223 nt, unidentified
  source 1..223: mol_type = other RNA; note = Related to JAIOJK010002653.1; note = Sandaracinaceae bacterium
acggggcgtgagcccgctgacctagccatccgtgcggcgctacgccgcgcaggcccacgtgcttcgcactcgtcacgtgcccgttcggcacacgcggcccacgcgggctcccgccctatgctgggtgggctgctccgcagccctcgggctttggagcccgcgtgggccgctcaagtggaacggtcgcgtccccaggaggttcgtaggcgccgctcgcgccccg

SEQ ID NO: 18721 - RNA, 223 nt, unidentified
  source 1..223: mol_type = other RNA; note = Related to JACRDB010000039.1; note = Deltaproteobacteria bacterium
acggtgcgcggggtacgcggtcttagcaatccgtgcggtgctacgccgtactttgctcccgtgcctgccattcgtcgcgagcccgttcgtcactcgcctaccacgcgggtgtcgcgcggtcgctggacgggttgttccacaacccaccgcgcgtacacccgcgtggtaggctattggtggaacggtcacgcccaagggatgttcgtaagcgccccgcgcatcg

SEQ ID NO: 18722 - RNA, 222 nt, unidentified
  source 1..222: mol_type = other RNA; note = Myxococcales bacterium; note = Related to JAEUKH010000004.1
gggcgaagggcgacgatgtagcaaccagtgcggcgttacgccgtgcttgtctccgtgcctgtcattcgtcacgagcaggttcgtcacccgcctaccaggggtaccgcgcaaggctactggttcgaccgctccgcggtcagccttgccgcggtacccccggtaggctttctgttgaacccgcgcgtcgatcgtagggatgttcgtacaacacagcccttcgcc

SEQ ID NO: 18723 - RNA, 194 nt, unidentified
  source 1..194: mol_type = other RNA; note = Related to JAIBCE010000260.1; note = Sandaracinaceae bacterium
tcggcctggccattcgtgaggcgctacgcctcgctggctcacacgctccccatccgtcacgggccttgtcggcactcgccgccgcggaccctgcccgcccgcagctgttcggggacctccggtccccgcgggcagtggcagggtccgcggcggctatagtggacccgtcccgtccgagggctctacgcaggccg

SEQ ID NO: 18724 - RNA, 241 nt, unidentified
  source 1..241: mol_type = other RNA; note = Related to NZ_CP011125.1; note = Sandaracinus amylolyticus
gcgaggagctccgcgcgcacgagcccactccgtctgtttcggcagcgcggagaccgcggcgttacgccgtggtggaacctgcttcctcatgcaaccccacgcccgatgttcttttgggcgccgcaggggcctgtgtccgacaccggagcgactcgatgagtccgtcggaacacaggcccccgcggcgccttcgtgatcggacgtggtccaacgcacgaagtcgagcacgcggggctcctcg

SEQ ID NO: 18725 - RNA, 219 nt, unidentified
  source 1..219: mol_type = other RNA; note = Deltaproteobacteria bacterium; note = Related to JACOUT010000011.1
acggagcgagcgtgcgcaggtagcaaccgcgcggcgatacgccgcgcatgccgaaatgcccggcattcgtcacgcgcccgttcttcacccgcggcccgcactaccctcagcgcccagctggatcggccgctccgcggcccgggcgctaacgagggtagtgcgggccgcttcagtggaacgagcacgtccgcagcatggtcgtactgcacgctcgctccg

SEQ ID NO: 18726 - RNA, 225 nt, unidentified
  source 1..225: mol_type = other RNA; note = Related to JADZDY010000308.1; note = Deltaproteobacteria bacterium
aggacggagcgagcgcgcgcatgtagcaaccgcgcggcgatacgccgcgcatgcccggatgtcagtcattcgtcacgcgcccgtacttcacccgcggcccgcactaccctcagcgcccagctggatcggccgctccgcggcccgggcgcttacgagggtagtgcgggccgcttcagtggaacgagcacgtcctgagcatgttcgtactgcacgctcgctccgtcc

SEQ ID NO: 18727 - RNA, 223 nt, unidentified
  source 1..223: mol_type = other RNA; note = Related to JAEUKD010000148.1; note = Myxococcales bacterium
acgggacgagaagggcaagatctagcaacccgtgcggtgttacgccgcgcttgcagtcgtgcttcgcattcgtcacccgcctattcgtcactcgacggatcgacacctgtcgtactcgcaagctgtatgggccgctccgcggcccgcggtactgacaggtgtcgatccgtcttaagtggaacaggcacgtcccgagagagtcgtaggtcccgctctcgtcccg

SEQ ID NO: 18728 - RNA, 223 nt, unidentified
  source 1..223: mol_type = other RNA; note = Related to JAHBWD010000079.1; note = Labilithrix sp.
ggatggggacgaggccagctctagcaaccgtgcggcgttacgccgtgcttgcctacgtgccgtgcattcgtcacgcgcccgttcgtcactcggcgctcgtcggacccgtccgaccgcatgctgtttgggtcgctccgcgacccgcggtcgtgacgggtccgcgagcgccttaagtggaacgagcacgtccccagggagctcgtagagatctctcgtccccatc

SEQ ID NO: 18729 - RNA, 216 nt, unidentified
  source 1..216: mol_type = other RNA; note = Related to PABA01000151.1; note = Sandaracinus sp.
acgaaggcgccgggtctagccatccgcacggtgctacgccgtgctggccgagctgctcgacattcgtcacgagtccgttcgtcaccacgggagccatgccccccgcacccttcgctggttcgacacctccggtgtcccgggctcacggggggcacggctcccattcagtggaacggcctcgtcctccgcaaggaacgtagacgccccgccccgtcg

SEQ ID NO: 18730 - RNA, 208 nt, unidentified
  source 1..208: mol_type = other RNA; note = Related to NZ_OKRA01000001.1; note = Clostridium sp.
gaaacacatggatttcttggcctttatactgtggtgttgcgccatggtggagatttgtcatacatacatcattaggttgcgcgcaattcgctacgctactaatactgtgcacattaaaaatcgatccttcggttatgtgacagtattagtgctacgctgaagtgtcacaaccgaatataagaattgttagcaagaaatatatgtagtt

SEQ ID NO: 18731 - RNA, 198 nt, unidentified
  source 1..198: mol_type = other RNA; note = Related to NZ_JAHXPT010000003.1; note = Clostridium weizhouense
acatagatttcttggcctttatgctgtggtgttgcgccacggtggagatttgtcaaatacacatcattaggttgcgcgcaattcgctacgctaccaatactgtgggcattaaaaatcgagccttcggttatgccacagtattggtgctacgctgaagtgtcacaaccaaatataagaattgttagcaagaaatctatg

SEQ ID NO: 18732 - RNA, 198 nt, unidentified
  source 1..198: mol_type = other RNA; note = Related to NZ_FOMG01000001.1; note = Clostridium uliginosum
acgtagatttcttggcctttatgcctcggtgttgcgccgcggtggagatttgttagacacacatcattaggttgcgcgcaattcgcttcgctaccaatactgtgcacattaaaaatcgagccttcggttatgtgacagtattggtgctacgctgaagtgtcacaaccaaatataagaattgttagcaagaaatctatg

SEQ ID NO: 18733 - RNA, 200 nt, unidentified
  source 1..200: mol_type = other RNA; note = Related to AE015927.1; note = Clostridium tetani
tttgtagatttcttggcctttatgctatggtgttgcgccatggtggagatttaccatacatacatcattaggttgcgcgcaattcgctacacgacctataatgtgcacatttaaaaccgatccttcggttatgtgacattataggtgttccgctgaagtgtcacaaccgaatataagaattgttagcaagaaatctataa

SEQ ID NO: 18734 - RNA, 200 nt, unidentified
  source 1..200: mol_type = other RNA; note = Related to NZ_QXDJ01000001.1; note = Clostridium chromiireducens
gagataggtttcttggcctttatactatggtggtgcgccatggtggagatttgttagacacacatcatcaggttgcgcgcaattcgctacgctaccaatactgtgcgcttttaaaaccgatccttcggttaagcgacagtattggtgctacgctgaagtgtcacaaccaaatacaagaatagttagcaagaaatctatcc

SEQ ID NO: 18735 - RNA, 200 nt, unidentified
  source 1..200: mol_type = other RNA; note = Related to NZ_AP024849.1; note = Clostridium sp.
ttgatagatttcttggcctttatgctgtggtgttgcgccatagttgagatttgttagaaacacatcatcaggttgcgcgcaattcgcttcgctaccactactgtgcacattaaaaaccgatccttcggttatgtgacagtagtggtgctacgctgaagtgtcccaaccagatataagaatagttagcaagaaatctatcg

SEQ ID NO: 18736 - RNA, 200 nt, unidentified
  source 1..200: mol_type = other RNA; note = Related to NZ_LZZM01000063.1; note = Clostridium puniceum
aagatagatttcttggcctttatgctgtggtgttgcgccatggttgagatttgtcacatacacaacattaggttgcgcgcaattcgctgcgctaccactactgtgcacatttaaaatcgagccttcggttatgtgacagtagtggtgctacgctgaagtgtctcaaccaaatatgagaatagttagcaagaaatctatca

SEQ ID NO: 18737 - RNA, 209 nt, unidentified
  source 1..209: mol_type = other RNA; note = Related to NC_015275.1; note = Cellulosilyticum lentocellum
gtgtactataaatttcttggcctttatgctacggtgtttcgccgtggtgcgtcatatagcttacatacttcactaggctctgcgcaattcgctacgctgccactactgtgcacatttaaaacctatcctgcggttatgtgacagtagtggcgctacgctgaagtgtcataacctaatcattggcttgttagcaagaaatttatagatca

SEQ ID NO: 18738 - RNA, 199 nt, unidentified
  source 1..199: mol_type = other RNA; note = Related to NZ_FQZB01000006.1; note = Clostridium cavendishii
gtagtaaacttcctggcctttatgcttcgatgtttcgtcgaggtcgagatttatatgccatacatcaccaggttacgcgcaattcgctacgctaccactactgtgcgactttaaaatctatcctacggtttgtcgacagtagtggtgctacgctgaagtgtcataaccagatataagattgttagcaggaagtttatta

SEQ ID NO: 18739 - RNA, 206 nt, unidentified
  source 1..206: mol_type = other RNA; note = Clostridiales bacterium; note = Related to JAAYMT010000202.1
aaagataacagttcccttggccttattgctgcggtgcttcgccgtggtggacatatgctaagcatacatcaccagcttgtgcgcaattcacttcgcaccactattgtgcacattgagaatggatccttcggctatgtgacaatagtgttgctacgctgaagtgtcacaagcagatagaagtttgttagcaagggaactgttttttt

SEQ ID NO: 18740 - RNA, 200 nt, unidentified
  source 1..200: mol_type = other RNA; note = Related to JACMJL010000131.1; note = Clostridiaceae bacterium
gtaatatactccttggcctttatacctcggcgctgcgccgcggttgagatttaccatacatacatcatcaggttctgcgcaattcgcttcgctactactactgtgcccatttaaaaaggatccttcggttttgggacagtagtagtgctacgctgaagtgtcaaaaccagataggagagtagttagcaaggagtctattg

SEQ ID NO: 18741 - RNA, 198 nt, unidentified
  source 1..198: mol_type = other RNA; note = Related to JAFGGO010000116.1; note = Candidatus Lokiarchaeota archaeon
atattggatttcttggccttcacgcctcggcgttgcgccgcggtcgaaacttgccaagcacacgacacctgggcgtgcgcaactcgcgtcgctacatatagtgtctgattgaaaatggagccttcggtgatcagacactatatgcgctctgctgaagtgtcactcccaactgtgagaaagttagcaagaaatccatta

SEQ ID NO: 18742 - RNA, 248 nt, unidentified
  source 1..248: mol_type = other RNA; note = Related to NZ_JAALJI010000007.1; note = Paludisphaera sp.
tcctggaaggtctcttctagctcggtgccctgcaccggggcggcgttgcgccgcccgagtttttcgccgaacatccgtcacaacgaaggctgtttcagactcgcttctcggtgggagtacccctcccggcggggcgggtctgggacaaccccgccggacggggttccgccccgccgggaggggtactcccaccggcgagtcagagagccttcgatgtcccaggtcttgtggtagacggaccgaccagg

SEQ ID NO: 18743 - RNA, 251 nt, unidentified
  source 1..251: mol_type = other RNA; note = Related to NZ_JAHPZK010000021.1; note = Paludisphaera sp.
gtcctgaagaggtctgtgctagctcgacgccctgcgtcggggcggcgttgcgccgcccgagtttcacgccgaacatccgtcacagcgaaggctgtttcagactcgcttctcgggggaataacccctccggcgtgggcgggcctggggcaaccccgccggacggggttccgcccacgccggaggggttattcccccggcgagtcagagagccttcgatgtcccaggttttgtggtagacgaacctctcagga

SEQ ID NO: 18744 - RNA, 244 nt, unidentified
  source 1..244: mol_type = other RNA; note = Related to NZ_WEZF01000007.1; note = Tautonia sp.
gattggagaacaggtctagctcgacgcttcggcgtcggggcggcgttgcgccgcccgtggaaacgatccgcttcgcatcacaacgaaggctgtttcaggcccgctgatcgccccgggggtgattaccttgtcggcgggcctggtccaaccgcgccgatcgcggttccgccgacaaggtaatcacccccggggcggcgggccagtgagccttcgatgtcccaggtctggtagtagactctccaat

SEQ ID NO: 18745 - RNA, 221 nt, unidentified; identical to SEQ ID NO: 18713
  source 1..221: mol_type = other RNA; note = Related to NZ_CP036426.1; note = Tautonia plasticadhaerens

SEQ ID NO: 18746 - RNA, 245 nt, unidentified
  source 1..245: mol_type = other RNA; note = Gemmataceae bacterium; note = Related to JAIENG010000522.1
ccggagaggacaggtctagctgcggtgcttcgcaccagggcggcgttgcgccgccccggcgtttgctatcccgtgcatcacaaggaaggctgttccagtcccgctgtcggcctacgccgaacatgttcacggtcgggctgggacaacctcgcagacgtggttccgaccatgaacatgttcggcgtaggccggcgtgactgtgagccttccgtgtcccaggtcgggtaagtcgagatgcctctccg

SEQ ID NO: 18747 - RNA, 242 nt, unidentified
  source 1..242: mol_type = other RNA; note = Related to JAHQVJ010000095.1; note = Myxococcales bacterium
acggagaggcggaaggtctagccattcggtcggcgttgcgccgcccaggaacaccagcacgcatccttcacaaggaaggctgttccagatcttgattttcggcggtgacgcccctaatcgaggatgggctggttcaacctcgccagtcgcggttccatgcctcgattaggggcgtcaccgccgacaagatcggtgagccttccatgtcccaggtctagcggtagcgaacgcccgcctctccc

SEQ ID NO: 18748 - RNA, 245 nt, unidentified
  source 1..245: mol_type = other RNA; note = Gemmataceae bacterium; note = Related to LR594586.1
ccgtcgagggggccgtccagctcgtcgctctgcgacaggacgatgttgcgtcgtccgagcgtttaccatcccacacagcccgaggaaggctgttccagcaccgctatcggcccgggggcaaccggttcggtcacggtctggagcaaccccgcggttcgtggttccgtgaccgaaccggttgcccccgggccggcggtgccgtgagccttccgcggaccaggtcaggtggtggacgcccctcgatg

SEQ ID NO: 18749 - RNA, 213 nt, unidentified
  source 1..213: mol_type = other RNA; note = Related to NZ_JAGKQQ010000001.1; note = Gemmata sp.
acggtgtccgtcgcgatccgagaccaccatgctgcgatgttccgtcgcggttgaagttgctcgcgattgcgtccccaggtgcgttgttcttgttcgcccgccccggaccggtcgggccgaactgaatcgacccgagtcctcggcccgaccggtccggggcgggcgtcgtgaacgcatctggtccacgattgaagtcggttgcggcggacaccg

SEQ ID NO: 18750 - RNA, 247 nt, unidentified
  source 1..247: mol_type = other RNA; note = Related to NZ_JH636447.1; note = Zavarzinella formosa
gcaacgaccttgagtttagctcgctgctttgcagcggggcgatgttgcgtcgcccgagcacatggcttgccatgctacccaaggacggctgttccaggaccgctttcgtgggcgcgccccctgatcacccggtggtctggagcaaccccgcgaatcgtggttccaccgggtgatcagggggcgcgcccacggcggtcccgtgagccgtccatgttccaggtcgagtggtaaacaggtcagcgtgatg

SEQ ID NO: 18751 - RNA, 255 nt, unidentified
  source 1..255: mol_type = other RNA; note = Related to NZ_NIDE01000001.1; note = Fimbriiglobus ruber
gtcggtcgcaggggaaacgatttagcttagttgctctgcaacggggcggcgttgcgccgcccgagcgtatggcttggcatgcgtcccgaggagggctgttccagacccgctttcggtggggggacgaattactccccaccggtctggtgctaccccgcgagtcggggttccggtgaggagtaattcgtccccccaccggcgggtccgtgagccctccacgtcccaggtcgagtagtaaatcacccctgcggccga

SEQ ID NO: 18752 - RNA, 215 nt, unidentified
  source 1..215: mol_type = other RNA; note = Related to NZ_CP036273.1; note = Urbifossiella limnaea
accctgggtcgtcgcgtccgagcctcaccaatgctgcggcgttccgccgcggttgccgatgcttgcgattgcgtcccccgagccgttggtctgttcgccggcacggggtactccccgccggtctgaatcgacctgcgtcaccggcggggagtaccccgtgccggcgtcgtgaacgtctcgggtccacgacagacgtcgggcgcgacgacccagga

SEQ ID NO: 18753 - RNA, 221 nt, unidentified
  source 1..221: mol_type = other RNA; note = Related to CP016211.1; note = Minicystis rosea
gcgaggagatccgaccgcccgagcccatcatgctgcggtgctacgccgtggcggagctcggtctaccatgcgtacccacacccgatattcttttgggcgccgagccccagtcgaaggccgtactcagacgaccgcgagcggtctctgccttcgactggggccggcgcctcggtgatcgggcgtggtcccaagggaagtagtcgggcggtcggatttcctcg

SEQ ID NO: 18754 - RNA, 255 nt, unidentified
  source 1..255: mol_type = other RNA; note = Related to JACKED010000003.1; note = Sandaracinus sp.
acgacgtggtcgggtcgagtctagcttggtgctctgcaccgtggtcggcgttgcgccgcccgagcgtctcgcttcgcatccgtcacaaggaaggctgttccagaacgtcgctatcgggtcatgcaccctctggtggcggcggtctggttcaaccccgctcgtcgtggttccgcgcgccaccagtgggtgcatgacccggcgagttcggtgagccttccgtgtccctggtcgagtcgtagacccccgaccacgccg

SEQ ID NO: 18755 - RNA, 257 nt, unidentified
  source 1..257: mol_type = other RNA; note = Planctomycetales bacterium; note = Related to JAGQPF010000572.1
gaccggcctggcggcacaggtctagcttggtgttctgcaccgtgggcggcgttgcgccgtccgagaggtttcccacgcattgcgtcacaaggaaggctgtttcagactcgctgatcgtcccctcggactactaattcccagcgagactggagcaacctcgccattcgcggttacgccgtgaattagtagtccgaggggacggcgagtcagtgagccttccatgtaccaggtcgtgaagtagattgccccgggccggt

SEQ ID NO: 18756 - RNA, 254 nt, unidentified
  source 1..254: mol_type = other RNA; note = Related to CP042914.1; note = Roseimaritima ulvae
gaatcgtgagagctcaggtctagctaggtgttttacaccgtgggcggcgttgcgccgtccgagagaattgactttcatggggtcacaaggaaggctgtttcagactcgctatcgcccggtaagggtacctattcacggcgagactggagcgacctcgccattcgtggtcacgccgcgaataggtacccttaccgggcggcgagtcagtgagccttccatgtaccaggtcgtgaagtagattgcttttagcgatc

SEQ ID NO: 18757 - RNA, 244 nt, unidentified
  source 1..244: mol_type = other RNA; note = Candidatus Uabimicrobium amorphum; note = Related to NZ_AP019860.1
taaaacttaaaagtttagctcggtagtttaccaagagcggcgtagcgccgttcgagaaaattcttcacattgcagcacaaggaagactgtttcagaacgtcgtgatactagatatagtgtctagtaagcggctgtctgattcaaccgcgccaatcgtagttccgcgcgcttactagacactatatctagtcgagttcagagagtcttccatgtccctagatatgaaagtagacttataagtttt

SEQ ID NO: 18758 - RNA, 237 nt, unidentified
  source 1..237: mol_type = other RNA; note = Related to NZ_FUYB01000016.1; note = Thiothrix eikelboomii
gtgaaaagtctagcgtttgatcttcggatccggttggcgttgcgccacctgtgcattaaaccgagcattgcaacacaaggaagactgtttcagcctcgctattgccctagataacgtaccggagtgggtacgagctgggtcaatcgcgccgccgcaatttcgtacccactccggtacgttatctagggcgcgagtcagtgagtcttccatgtaccaggtattaaggtagatttttca

SEQ ID NO: 18759 - RNA, 237 nt, unidentified
  source 1..237: mol_type = other RNA; note = Related to NZ_AQVE01000007.1; note = Thiolinea disciformis
aagaaaagtctagcgtttgatcttcggatccggttggcgttgcgccaactgtgcgttaaaccaagcattgcaacacaaggaagactgtttcagcctcgtttatgcactcaatttgttatggagagtgctacgagctgggacaattgcaccactgcaatttcgtagcactctccataacaaattgagtgcacgagtcagtgagtcttccatgtaccaggtagtcaggtagatttttct

SEQ ID NO: 18760 - RNA, 241 nt, unidentified
  source 1..241: mol_type = other RNA; note = Related to NZ_KB904782.1; note = Thiofilum flexile
catgaaaagtctagcgattgatcttcggatcaagattggcgttgcgccactctcgaattaaacctaagcattgatcacaaggaagactgtttcagtctcgtttacgcccataaatagtcctcccggcgtactcgagctggaactatcacgcaaacgtgatttcgagtacgccgggaggactatttatgggcacgagccagtgagtcttccatgtacccggtattcaggtagattttttcat

SEQ ID NO: 18761 - RNA, 239 nt, unidentified
  source 1..239: mol_type = other RNA; note = Related to VIAD01000001.1; note = Moraxellaceae bacterium AER2_44_116
aatgaaaattctagcgttaaccttcgggttgaggcggtgatgcgccgcttttgaattaagcttacacattgatcacaaggaagactgtttcagccccgctattgccactaagtacgtgccgtagcagtagcgagctggaacaatcacgcaaccgtgatttcgctactgctacggcacgtacttagtggcgcgggtcagtgagtcttccatgtaccaggtcattcaggtagatttttcat

SEQ ID NO: 18762 - RNA, 247 nt, unidentified
  source 1..247: mol_type = other RNA; note = Related to NZ_CAJHAL010000004.1; note = Psychrobacter nivimaris
gagttgtgagatttagcgtttcaccgtttacggtgaggggcgacgttgcgtcgtccacgagtcaagccattacattttacccaaggaagactgtttcagtcctgctaatacctagataaaggccctagtgtcattagctcgctggcgcaatcacgcaatcgtgattgagctaatgcactagggcctttatctaggtgcagtccagtgagtcttccatgtaccaggtcatgaggtagattacacaaca

SEQ ID NO: 18763 - RNA, 247 nt, unidentified
  source 1..247: mol_type = other RNA; note = Related to NZ_VFYU01000031.1; note = Psychrobacter sp.
tgtgagatttagcgtttcactgcttgcagtgagggacgatgttgcgtcgtccacgagacaagcctgtacatttgacacaaggaagactgtttcagccctactaatacctaatatagccctctagtgtattagttcgctggcgcaatcacgcaaacgtgattgaactaattacactagagggctatattaggtgtaggtcagtgagtcttccatgtacccagttatgaggtaaatcaacaacacacac

SEQ ID NO: 18764 - RNA, 242 nt, unidentified
  source 1..242: mol_type = other RNA; note = Related to NZ_CP047226.1; note = Moraxella osloensis
aagttgtgagatttagcgtttcaccgcaaggtgaagggcgatgttgcgtcgcttatgagtaaagccactacattttgcacaaggaaacctgtttcaggatagctgatacctaaatagggggtctagtgcaatagctcgctggcgcaatcacgcaaacgtgattgagctatagcactagaccccctatttaggtgctatccagtgaggcttccatgtaccatgtcatgaggtaaaccacaact

SEQ ID NO: 18765 - RNA, 254 nt, unidentified
  source 1..254: mol_type = other RNA; note = Related to NZ_NDXW01000001.1; note = Zooshikella ganghwensis
actgtacttgctggtcatggtctagcttggtggaaacaccggggcggtgatgcgccgttcttgcttattgctatgcactgtacacaaggaaggctatttcaggctcgctttgccactatataccgttatggtaaccagcgacctgagccaaccacgcaatcgcggttacgctagttaccataacggtatatagtggcgcgatccagtgagccttccatgtcccaagtcatgaagtagatacacagcaagtagaa

SEQ ID NO: 18766 - RNA, 222 nt, unidentified; identical to SEQ ID NO: 18521
  source 1..222: mol_type = other RNA; note = Related to NZ_CP048878.1; note = Spartinivicinus ruber

SEQ ID NO: 18767 - RNA, 269 nt, Vibrio sp.
  source 1..269: mol_type = other RNA; note = Related to NZ_CP018616.1; note = Vibrio azureus
acttaaagggaatgaagtctagcttatatcattttactgttcgtaaaatgatgtgattggcgttgcgccactcctgtatattctctgacatataacaccaagaagattatttcagcatcacgtgtactccctataggggttaagttacgagatgcctggaacaaccgcgtgaacgcggttgcgatctcgcaacttaacccctatagggagtgtgatgcggtgaatcttctaagtcccaagtctagtagtagaataaatttcgctttagg

SEQ ID NO: 18768 - RNA, 254 nt, unidentified
  source 1..254: mol_type = other RNA; note = Deltaproteobacteria bacterium; note = Related to JAHBVW010000060.1
gagaaggagtcgaggagatcgttagccagcacttcggtgcaagagcggcgtcgcgccgctcgggtacaattactggccattctccacaaggtaggctgttcttggtccgctcgcgcgcggggccccatcgcgcactgctcagctggaccaaccacaccaccgcggtttgagcagtgcgcgatggggccccgcgcgcggcgaaccggtgagcctaccgtgtcccatgagggaggtagcgaccctcgactccttct

SEQ ID NO: 18769 - RNA, 250 nt, unidentified
  source 1..250: mol_type = other RNA; note = Related to VBLP01000042.1; note = Deltaproteobacteria bacterium
gaggaggagtcgaatccgttagccagcgctccggcgcaagggcggcgtcgcgccgtccgggcacaatcaagggccattctccacaaggtaggctgttcttggtctgctcgccctgcaggggtactgcgtacgggctcagctggaccaaccacaccactgcggtttgaacccatacgcagtacccctgcagggcggcagaccggtgagcctaccgtgtcccatgagggatgtagcggattcgactcctcct

SEQ ID NO: 18770 - RNA, 251 nt, unidentified
  source 1..251: mol_type = other RNA; note = Related to JADJJK010000055.1; note = Myxococcales bacterium
aaggagaagctctacccgttagcctgcgcgcaagcgcatgggcggcgtcgcgccgcccgggttcaacaactcgccattctccacaaggtaggctgttcgtggtttgctcggccatcgcccctcctagtagtgggctcagctggaccaaccacgccaccgcggtttgagcccactactaggaggggcgatggccggcaaaccggtgagcctaccgtgtcccatgagggatgtagcgggtcagagcttttcct

SEQ ID NO: 18771 - RNA, 254 nt, unidentified
  source 1..254: mol_type = other RNA; note = Myxococcales bacterium; note = Related to JADJUF010000001.1
caggaagaggagtcgccttcgttagcctgcgctccggcgcaagggcggcgtcgcgccgtcccggcacaagcagtagccactctccacaaggtaggctgttcttggttcgctcgcccagaggggccccaattgtcgggtccagctggaccaaccgagcgaacccggtttgcacccaacaattggggcccctctgggcggcgaacctgtgagcctaccgtgtcccatgagggttgtagcgagcgcctcctcttcct

SEQ ID NO: 18772 - RNA, 251 nt, unidentified
  source 1..251: mol_type = other RNA; note = Related to JADJFN010000004.1; note = Myxococcales bacterium
gaagaggagtcgtcttcgttagcctgcgctccggcgcaagggcggcgtcgcgccgtcccggcacacgcagtagccactctccacaaggtaggctgttcttggttcgctcgcccagaggggccccaattgttgggtccagctggaccaaccgagcgaacccggtttgcacccaacaattggggcccctctgggcggcgaacctgtgagcctaccgtgtcccatgagggatgtagcgagcggcgactcccctt

SEQ ID NO: 18773 - RNA, 252 nt, unidentified
  source 1..252: mol_type = other RNA; note = Related to NZ_PVNL01000069.1; note = Enhygromyxa salina
ccgtggggttgccgggatcgttagccgtgctcagcacagagcggcgttgcgccgctcgggcacactcttccgacactctccacaaggtaggctgttcgtggtttgcctggcctcgtacgcgtcgaagacgtcgacgtggctgggccaaccacgcaaccgtgggtcacgtcgacgtcttcgacgcgtacgaggccgcaaaccggtgagcctaccgtgtcccaagtgggatcgtagcgacacgatgatcccgcg

SEQ ID NO: 18774 - RNA, 193 nt, unidentified
  source 1..193: mol_type = other RNA; note = Related to JAGQIO010000454.1; note = Myxococcales bacterium
tcgttgtcggggatcgttagccgtgctccgcacaggtcggcgcagcgccgtccgggcacattcttccgacattctccacaaggtaggctgttcgtggtttgtctgggtgcccaagccctcgccggagcagcttggctggaccaaccacgcaaccgtgcttcaagctgctccggcgagggcttgggcacccaca

SEQ ID NO: 18775 - RNA, 253 nt, unidentified
  source 1..253: mol_type = other RNA; note = Related to JAEPMI010000008.1; note = Deltaproteobacteria bacterium
ggagggaaggtcgggttcgttagccggtgcttcggcactcgggcggcgcagcgccgccctggcacgacacttcgtcattctccacaaggtaggctgttcgtggttggcctcgggggagggggtatccccgccacccctagctgggccaaccgcgctaccgaggtttaggggtagcggggataccccctcccccgggccaaccggtgagcctaccgtgtcccatgtgagcaggtagcgagcccggcctttcctc

SEQ ID NO: 18776 - RNA, 241 nt, unidentified
  source 1..241: mol_type = other RNA; note = Related to JACKEN010000012.1; note = Deltaproteobacteria bacterium
ggtggaggagtcgttactcgttagcttttgggcggcgtcgcgccgtccaagctcagtcattcggcaatctccacaaggtaggctatgcgtggtttggctcccaccagggggtactagttgtcggcctagctgggccaaccacgcatccgaggttcaggccaacaactagtaccccctggtggggccaaaccggtgagcctaccgtgtcccatgttggaagtggcggtctcggttcctccac

SEQ ID NO: 18777 - RNA, 253 nt, unidentified
  source 1..253: mol_type = other RNA; note = Myxococcales bacterium; note = Related to JAHQVK010000212.1
gggagaaagctcagctggaagtgagtatgtgcttcggcaccaggatggcgtagcgccatctagtctatctaacttagcattctccacaaggtagcctgttctcgtgctaagtgccaccggtactaggggtgtctggcctagctggatcaaccacgcaaccggggtttaggccgagacacccctagtaccggtggcacttagcacggtgaggctaccgtgtccccagtgggaaggtcactgccaggctttctct

SEQ ID NO: 18778 - RNA, 253 nt, unidentified
  source 1..253: mol_type = other RNA; note = Deltaproteobacteria bacterium; note = Related to JACQYO010000157.1
aggagagagagcgggccgctagcttgtgcttcggcacgcgggtggtgttgcgccacccgtgcgtgatggcctgacatgctccacaaggtaggctgttcgtggttgcctcgccaggagagggtcccctctacgggcgtagctggaccaaccacgcaaccgcggtttacgcccgttagaggggaccctctcctggcggtcaaccggtgagcctaccatgtccctcgtgaggaagtagcgaacccgctccctctcc

SEQ ID NO: 18779 - RNA, 254 nt, unidentified
  source 1..254: mol_type = other RNA; note = Deltaproteobacteria bacterium; note = Related to JACPFK010000066.1
gaggagagagagcgggtcgttagctcgtgcttcggcacgcgggcggtgttgcgccgcccgtgcgtgatggcccgacatgctccacagggtaggctgttcgtggttgcctcgccaggagagggtcccctctccgggcgtagctggaccaaccacgcaaccgcggtttacgcccagtagaggggaccctctcctggcggtcaaccggtgagcctaccatgtccctcgtgaggaagtagcgaaccgctccctctcct

SEQ ID NO: 18780 - RNA, 241 nt, unidentified
  source 1..241: mol_type = other RNA; note = Related to JAGQIK010000702.1; note = Myxococcales bacterium
cgggggagagccgggcaaagttagccatttgggcggcgttgcgccgtcctggccttacaactcggttcactccacaaggtaggctattcgtggtttgctcgccccggacgggtactatggggcgggttagctggaccaaccacgcaatcgcggtttaacccaccccatagtacccgtccggggcggcaaaccggtgagcctaccgtgtcccaggtgggaaagtagcttccggctcttcccc

SEQ ID NO: 18781 - RNA, 253 nt, unidentified
  source 1..253: mol_type = other RNA; note = Sandaracinaceae bacterium; note = Related to JAIOJK010001035.1
tcgaggagagtcggggccgttagcccgtgcaaccgcacgcgggcggcgtctcgccgcccaggcccattcgcagagcatccgccacaaggtaggctgtgcgtggttcggctgccaggagggggtcctgatcacctcccctgctggtccaaccccgcatccgtggtttggggaggtgatcaggaccccctcctggcgccgaaccggtgagcctaccgtgtcccatgtaaggacgtagcggtcccgactctcctcc

SEQ ID NO: 18782 - RNA, 253 nt, unidentified
  source 1..253: mol_type = other RNA; note = Related to NC_013440.1; note = Haliangium ochraceum
ggagcgggactcggaagcattagcctgtgcttcggcacacgggcggcgttgcgccgtctaggcttaatctcgacacactcgccacaaggtaggctatgcgtggtttctctaccccaatgggcccctgctcccggggatagctggaccaaccacgcaatcgcggtttatccccaggagcaggggcccattggggtgagaaaccggtgagcctaccgtgtcccatgtaggatggtagtgattccgagttcctctc

SEQ ID NO: 18783 - RNA, 241 nt, unidentified
  source 1..241: mol_type = other RNA; note = Kofleriaceae bacterium; note = Related to JAESTW010000770.1
ggagaagggattgggaaaaagttagccatcgggcggcgtagcgccgtccaggtacagtcttcggacaatcgccacaaggtaggctattcatggtgaatctcccctataggggtacctgcaccacggatagctggaccaacctcacaactgcggtttatccgtagtgcaggtacccctatagggggattcaccggtgagcctaccgtgtcccgtgtaggatagtagctctcaatcccttctc

SEQ ID NO: 18784 - RNA, 253 nt, unidentified
  source 1..253: mol_type = other RNA; note = Related to PABA01000191.1; note = Sandaracinus sp.
ggaggggaggacggagccattagcccgtgctcgtcacgggggcggcgcagcgccgtccaggcaacgcattccgacaatctccacaaggtaggctgttcgtggttggcactcgggggagggggtaccgtcggcccccctagctggaccaaccacgccaccgcggtttaggggggccgacggtaccccctcccccgggccaaccggtgagcctaccgtgtcccaggtgagaaggtagcggctccgccctcccctc

SEQ ID NO: 18785 - RNA, 255 nt, unidentified
  source 1..255: mol_type = other RNA; note = Related to JACKDV010000022.1; note = Myxococcales bacterium
ggagagggaaccgagctcgttagccacgtgcttctgcacacgggcggcgctgcgccgccccggttcaacatcactgcatcactccacaaggtaggctgttcgtggtttgtcaggtacggagggggtcgtagcgaccgggttatctggaccaaccacgcagccgtcgttcaacccagtcgctacgaccccctccgtaccacaaaccggtgagcctaccgtgtcccgtgtcgagcagtagcgtctcggttccctttc

SEQ ID NO: 18786 - RNA, 254 nt, unidentified
  source 1..254: mol_type = other RNA; note = Related to JAGQIQ010001415.1; note = Myxococcales bacterium
ggagagggaaccgagttcgttagccacgtgctttgcacatgggtggcgctgcgccaccccggtccaacatcactgcatcgctccacaaggtaggctgttcgtggtttgtcaggtacggagggggtcctagcgaccggattatctgggccaaccacgcaaccgtcgttcaatccagtcgctaggaccccctccgtaccacaaaccggtgagcctaccgtgtcccgtgtcgagaagtagcgtctcggttccctttc

SEQ ID NO: 18787 - RNA, 256 nt, unidentified
  source 1..256: mol_type = other RNA; note = Related to NZ_RAVZ01000142.1; note = Corallococcus terminator
gagagaggtctggaccgcatcagccttagcgcctcgagcgcgggagcggcgttgcgccgctctggttgaaatgctggacactctccgcaaggtagcctgttcttggctctctccctccggtgcactggtggccgggtgggaagcggaaccaacgacgcaaccgccgttttcccacccggccaccagtgcaccggaggggagagccggtgaggctaccgtgccccaggtgagctggtggtgcattcctggcctccct

SEQ ID NO: 18788 - RNA, 256 nt, unidentified
  source 1..256: mol_type = other RNA; note = Related to NZ_FOIB01000017.1; note = Myxococcus fulvus
gagagaggtctggagtgcatcagcctgagcgcctcgagcgcgggagcggcgttgcgccgctccggtttgaatgcaggacactctccgcaaggtagcctgttcttggctctctccctcccatgcactacggccggggtgggcagcggagccaacgacgcgaccgccgtttgcccaccccggccgtagtgcatgggaggggagagccggtgaggctaccgtgccccaggtgagatggtggtgctttcctggcctccct

SEQ ID NO: 18789 - RNA, 256 nt, unidentified
  source 1..256: mol_type = other RNA; note = Related to JABBJJ010000287.1; note = Pyxidicoccus fallax
gagagaggtctggagtgcatcagcctgagcgcctcgagcgcgggagcggtgttgcgccgctccggttggaatgcaggacactctccgcaaggtagcctgttcttggctctctccctcctaggcaccatggcccgggtgggtagctgagccaacgacgcgaacgccgtttacccacccgggccatggtgcctaggaggggagagccggtgaggctaccgtgccccaggtgagatggtggtgccttcccggcctccct

SEQ ID NO: 18790 - RNA, 256 nt, unidentified
  source 1..256: mol_type = other RNA; note = Related to NC_020126.1; note = Myxococcus stipitatus
gagagaggtccggagtgcatcagcctgagcgcctcgagcgcgggagcggcgttgcgccgctccggttggaatgcaggacactctccgcaaggtagcctgttcttggctctctccctcctaggcactgcggccggggcgggcagcggagtcaacgacgcgaccgccgttcgcccgccccggccgcagtgcctaggaggggagagccggtgaggctaccgtgccccaggtaagatggtggtgctttcccggcctccct

SEQ ID NO: 18791 - RNA, 256 nt, unidentified
  source 1..256: mol_type = other RNA; note = Related to NZ_JAHNZT010000021.1; note = Citreicoccus inhibens
gagagaggtccggagcgcatcagccttagcgcctcgagcgcaggagcggcgttgcgccgctctggttgaaatgcaggacactctccgcaaggtagcctgttcttggctctctccctcctaggcaccatggccacggcgggaagcggagccaacgacgcgaccgccgttttcccgccgcggccatggtgcctaggagggaagagccggtgaggctaccgtgccccaggtgagatggtggtgctttcccggcctccct

SEQ ID NO: 18792 - RNA, 257 nt, unidentified
  source 1..257: mol_type = other RNA; note = Related to NZ_JPMI01000131.1; note = Archangium violaceum
cgagagaggtccggaaagcatcagccttcgcgcctcgagcgcgggagcggcgctgcgccgctctggaagcaatgcaggacactctccgcaaggtagcctgttcttggcgctctcccggtagaggggtctaggcctctcggggagctgagccaacgacgcaaccgccgtttccccaagaggcctagacccctctaccggggagcgccggtgaggctaccgtgccccaggtgagcatgtggtgattccaggcctctctc

SEQ ID NO: 18793 - RNA, 257 nt, unidentified
  source 1..257: mol_type = other RNA; note = Related to NZ_JAHXBG010000001.1; note = Cystobacter gracilis
gggagaggtcccaaagccatcagcctcagcgcctcgagcgcgggagcggcgttgcgccgctctggatgcaatgcaggacactctccgcaaggtagcctgttcttggctctcttccctcgatcagtactatgacggggtgtagagctgagccaacgacgcaaccgccgtttctccaccccgtcatagtactgatcgaggggagagccggtgaggctaccgtgccccaggtgagcaggtggtgccttgggggcctccct

SEQ ID NO: 18794 - RNA, 257 nt, unidentified
  source 1..257: mol_type = other RNA; note = Related to NZ_FOAP01000003.1; note = Stigmatella aurantiaca
cgagagaggtcccaagccatcagcctcagcgcctcgagcgcgggagcggcgttgcgccgctctggttgaaaagcaggacactctccgcaaggtagcctgttcttggctctcttccctccggtactgccctcccgggccggggagctgagccaacgacgcgaccgccgttcccccggcccgggagggcagtaccggaggggagagccggtgaggctaccgtgccccaggtgagaaggtggtgcctttgggcctccctc

SEQ ID NO: 18795 - RNA, 256 nt, unidentified
  source 1..256: mol_type = other RNA; note = Related to JACSRE010000153.1; note = Myxococcus sp.
gagcggggtgtcgagatcttcagccttcgcgcttcagtgcgcaggagcggcgttgcgccgctctggagaatcgtccgacatccatcgctaggtagcctgttcttggctctcctcggcagaggggcatcctccgcgtgggagagctgagacaactgcgcgaacgcagtttctcccacgcggaggatgcccctctgccgggagagccggtgaggctaccgagccccaggagagaaggtggtgctttcggcgccccact

SEQ ID NO: 18796 - RNA, 256 nt, unidentified
  source 1..256: mol_type = other RNA; note = Related to JAGNNG010000134.1; note = Deltaproteobacteria bacterium
ggagaggtaccgagcgcttcagcctaagcgcctagagcgcaggaacggtgttgcgccgttctggtcgaactgctggtcaatctccgcaaggtagcctgttcttggttcgctctagctacacccctcggcgtgcagctagtatctgaatcaacgacgccaaccgccgtttactagctgcacgccgaggggtgtagctaggcgaaccggtgaggctaccgtgccccaggtgagaaggtggcgctgctcggcgcctccc

SEQ ID NO: 18797 - RNA, 250 nt, unidentified
  source 1..250: mol_type = other RNA; note = Related to NZ_ASRX01000060.1; note = Chondromyces apiculatus
gaggtactgaacgcaccagactccgcgccttgagcgcaggagcggcgtcgcgccgctctggagtaaccactggtcattctcagcaaggtagcctgttcttggttctcttcggcgctacgcgctctacggcgccgggagatctgagacaacgcctcgaccgccgtttctcccggcgccgtagagcgcgtagcgccggagaaccggtgaggctaccgtgccccaagagaagaaggtgatgcgttcagcgcct

SEQ ID NO: 18798 - RNA, 219 nt, unidentified
  source 1..219: mol_type = other RNA; note = Related to NC_010162.1; note = Sorangium cellulosum
gcaaggagatccgtccgctcgagcccaacatgctgcggcgctccgccgtggtggaggttgttcttccatgcatccccacccccgatgttctttgggcgcctttagcacctgcgcggttccactcagagggacctgacggtcctggaaccgcgcaggtgcccggcgcctgggtgatcgggcgtggtcacgagcaagtagtcgggcgggcgggcctccttg

SEQ ID NO: 18799 - RNA, 258 nt, unidentified
  source 1..258: mol_type = other RNA; note = Polyangiaceae bacterium; note = Related to JADLAG010000095.1
aggagaggttttgaacgcaccagcctccgcgcctcgagcgcaggagcggcgccgcgccgctctggaggaaccgctcgacattctccgcaaggtagcctgttcttggttctcttcggcatagccggctctactacgccgggagagctgagacaacgtcacgaccgccgtttctcccggcgtagtagagccggcgatgccggagaaccggtgaggctaccgtgccccaagaatagatggtgatgcgctcaatacctctct

SEQ ID NO: 18800 - RNA, 256 nt, unidentified
  source 1..256: mol_type = other RNA; note = Related to JABWBE010000187.1; note = Polyangiaceae bacterium
aggagaggttctgaagcaccagcctccgcgccttgagcgcaggagcggcgccgcgccgctctggaggatccgccagacactctccgcaaggtagcctgttcttggttctcttcgccggtagagcatccctagcgcggggagagctgagacaacgacccgactgccgtttctccccgcgctagggatgctctaccggcggagaaccggtgaggctaccgtgccccatggtagaaggtgatgctttcggggcctctct

SEQ ID NO: 18801 - RNA, 257 nt, unidentified
  source 1..257: mol_type = other RNA; note = Polyangiaceae bacterium; note = Related to JADJRH010000001.1
gtgaggcgcaaatgcgcaccagcctacgcgccttgagcgcaggagcggcgtcgcgccgttctggaaacaccgcctgtcattgttccgcaaggtagcctgttcttggttctcttcgcgctccccacccctgaagcgcgcggagagctgaaccaacgacgcagaccgccgtttctccgcgcgcttcaggggtggggagcgcggagaaccggtgaggctaccgtgccccatgggagaaggtgatgcgacttttcgcctct

SEQ ID NO: 18802 - RNA, 242 nt, unidentified
  source 1..242: mol_type = other RNA; note = Related to NZ_CBTJ020000010.1; note = Candidatus Competibacter denitrificans Run_A_D11
agcgtgaggcgttcctccattagccgtttgggcggcgttgcgccgtccgggatttccaacgccacacacgccacaaggtaggctgttcttggcccgcttcgcctaataccgtgccggtagcatggcggagctgggccaaccacgccaccgcggtttccgccatgctaccggcacggtattaggcggcgggccggtgagcctaccgtgtcccttgtgagaagtagcggtttgcgccctcacgc

SEQ ID NO: 18803 - RNA, 243 nt, unidentified
  source 1..243: mol_type = other RNA; note = Candidatus Competibacteraceae bacterium; note = Related to CP065007.1
gagcgtgaggcgttcctccattagccttttgggcggcgttgcgccgtccgggaattccaacgccacacacgccacaaggtaggctgttcttggccagcttcgccagtacccgcccctagttgtcggcggagctgggccaaccacgccaccgcggtttccgccaacaactaggggcgggtactggcggctggccggtgagcctaccgtgtcccttgtgagaagtagcggtttgcgcctcacgct

SEQ ID NO: 18804 - RNA, 211 nt, unidentified
  source 1..211: mol_type = other RNA; note = Related to JAFKJJ010000105.1; note = Planctomycetes bacterium
aaggtgtccgtcgcgagccgagaccttctctgcggcgttccgccgcgggtgagtttgcttgcgattgcgtccccgggcgcgttgttcttgttcgccgaccgtcacgcgcggtcgccggactgaatcaacctgcgttcacgccgaccgcgcgtgacggtcggcgtcgtgaacgcacccggtccacggatgaagtcggtcgcgacggacaccg

SEQ ID NO: 18805 - RNA, 211 nt, unidentified
  source 1..211: mol_type = other RNA; note = Related to VGZJ01000002.1; note = Planctomycetes bacterium
accaagcggccggctccgagacttaaacgtcctgcggcgttccgccgcgggtgaagtcgccagcgattgcgcccccgagcgcgttgttcttttcgcctccagaaataggtagttggcgaactgaaccgacctgcgttttcgccaactacctatttccggaggcgtcgtgaacgcgctcggtccgggtcggaagtcggagccggccgctttg

SEQ ID NO: 18806 - RNA, 213 nt, unidentified
  source 1..213: mol_type = other RNA; note = Related to PNKH01000071.1; note = Isosphaera sp.
tcttcgggtggccggtgtccgagacttcctctgcggcgctccgccgcgggtgacgttggcttgcgatgcgtccccagagccgttggtcttttcgccgggatattcacccccgggcgggactgagccaaccagcgttccccgcccgggggtggatatcccggcggtcgtgaacgactctggtcccggatcgaagtcggacccggccacccgttg

SEQ ID NO: 18807 - RNA, 213 nt, unidentified; identical to SEQ ID NO: 18749
  source 1..213: mol_type = other RNA; note = Related to NZ_JAGKQQ010000001.1; note = Gemmata sp.

SEQ ID NO: 18808 - RNA, 219 nt, unidentified
  source 1..219: mol_type = other RNA; note = Related to JAIEQO010000648.1; note = Gemmataceae bacterium
aacttgggcggccggttcccgagcctcaccactgctgcggcggtccgccgcggtttggagtcgcttgcgattgcgtccccggaggcgttggtcttttcgcccgagagttcaagggaggggcggactgtgccaacctgcgtatccaacccctcccttgaactctcgggcggtcaggaacgcccccggtcggcggatgaagtcggggccggccgcccttga

SEQ ID NO: 18809 - RNA, 215 nt, unidentified; identical to SEQ ID NO: 18752
  source 1..215: mol_type = other RNA; note = Related to NZ_CP036273.1; note = Urbifossiella limnaea

SEQ ID NO: 18810 - RNA, 209 nt, unidentified
  source 1..209: mol_type = other RNA; note = Related to LSTD01000254.1; note = Planctomycetaceae bacterium SCGC AG-212-F19
tgggggcgtgcagcttcgagaccatcttgctgcggtgttccgccgcggttgacgttggcttgcgttgcatccccagggccgttgttcttttggctggccaccgaggggttgcggcctgcctgagacaacacggtcgcggccgcaacccctcggtggccagccgtgtgaacgtccctggtcggcgcctcgaagtcgaagctgccgccccc

SEQ ID NO: 18811 - RNA, 215 nt, unidentified
  source 1..215: mol_type = other RNA; note = Related to NZ_LR593887.1; note = Tuwongella immobilis
ttgcgattcactctccttgcgagacgattctcaggtgttccgcctgggttgaagttgcctgcgattgcgttctccaagccgttgttctttttgcccacatgcccggcaccggcgggtaggctgagccaacggatgttttgcccgccggtgccaggcatgtgggctcggtgaacgtcttggatcctgacttggaagtcgcaaggtggtgcgtcgcg

SEQ ID NO: 18812 - RNA, 218 nt, unidentified
  source 1..218: mol_type = other RNA; note = Related to NZ_JAALJH010000005.1; note = Aquisphaera sp.
agggtggccgggccggagctcgagaccaccttgccgcggcgatccgccgcggtcgaccttgccccggagaatgcttccccagcgccgttgttcttttcggccggcggacctacccgcgggccgtgctgagtcgacgtgtccctgcccgtgggtaggtccgccggcctcggtgaacgacgctggtcggcgcctcgaagtcgggtccggcccgtcctccc

SEQ ID NO: 18813 - RNA, 218 nt, unidentified
  source 1..218: mol_type = other RNA; note = Related to NZ_CP042997.1; note = Aquisphaera giovannonii
agggtggccgggccggagcccgagaccatcttgccgcggcgatccgccgcggtcgaacgtgacccggagaatgcttccccagcgccgttgttcttttcggcaacaggggctccctgcaggccgagctgagtcgacaggtccctgcctgcagggagcccctgttgccttggtgaacgacgctggtcggcgcctcgaagtcggggccggcccgtcctccc

SEQ ID NO: 18814 - RNA, 218 nt, unidentified
  source 1..218: mol_type = other RNA; note = Related to NZ_JAHPZK010000060.1; note = Paludisphaera sp.
agggcgtccgggtcgtttccgagaccaccctgctgcggcgttccgccgtggccgaccttgcctccgtcgttgcttccccgagagcgttgttcttttggcccggtggagagctctcccgccgggctgagtcgaccgatgtccccggcgggagagctctccaccgggcctcggtgaacgccctcggtcgtcgcctcgaagtcggagcggcccggacgccc

SEQ ID NO: 18815 - RNA, 215 nt, unidentified
  source 1..215: mol_type = other RNA; note = Related to NZ_JAALJI010000068.1; note = Paludisphaera sp.
tcgaggcgggtcgtcgtcgagaccaccctgccgcggcgctccgccgcggccgagcttgccgcccgcgttgcttccccgagcgcgttgttcttttggcccggtgcgagtacctcacgccgggctgagtcgaccgaagtccccggcgtgaggtactcgcaccgggcctcggtgaacgccctcggtcgtcgcttcgaagtcggcggcggcccgcctcg

SEQ ID NO: 18816 - RNA, 213 nt, unidentified
  source 1..213: mol_type = other RNA; note = Related to CP003364.1; note = Singulisphaera acidiphila
gaggcgggccggggcccgagaccagcatgctgcggcgttccgccgtggtcgactctgcccccgagactgcttccccaagagtgttgttcttttggcccggggccgtagccgtacgccgggctgagtcaaccgttgttcccggcgtacggctacagccccgggcctcggtgaacacccttggtcgtcgcttcgaagtcgggcaacggcccgtcc

SEQ ID NO: 18817 - RNA, 217 nt, unidentified
  source 1..217: mol_type = other RNA; note = Related to JAIEMG010000080.1; note = Gemmataceae bacterium
agggggtgttccgacggtgttccgagaccatcttgctgcggtgttccgccgcggttgacgttggctcgtgcatgcttccccaaggccgttgttcttcaggcccgtccgcacgctcgcgggcgggctgaggcaacgagttcccgcccgcgagcgtgtggacgggcctcggtgaacgaccttggtcggcgcctcgaagtcggacctgtcgggcacccct

SEQ ID NO: 18818 - RNA, 214 nt, unidentified
  source 1..214: mol_type = other RNA; note = Related to JAJKFQ010000002.1; note = Stieleria sp.
gaggagtgaatcgacgatcgagcctaatttgctgtggtgctacgccatggtgtgagcttgctttgctatgcttccccaagcccgttgttcgttcgccagatacgacaccgtatcggcggactgagtcaacaaggttttcgccaatacggtgtcgtatctggcttggtggaacgtccttggtcaacgcgttgaagtcggtcgctcggacactcct

SEQ ID NO: 18819 - RNA, 214 nt, unidentified
  source 1..214: mol_type = other RNA; note = Related to PPHI01000001.1; note = Rhodopirellula baltica
gaggagtgcgtcgtcgaccgagactaatttgctgtggtgttacgccatggtttgagattgcttcgccatgcttccccaaagccgttgttcgttcgccagagactacaccgtagcggcgaactgaagcaacgaggtttacgccgctacggtgtagtctctggcttgggtgaacgaccttggtcaacgcgttgaagtcggtcgcacgaacactcct

SEQ ID NO: 18820 - RNA, 213 nt, unidentified
  source 1..213: mol_type = other RNA; note = Related to NZ_VSZO01000001.1; note = Proposed Roseiconus lacunae
gaggagtgaatcgacgaccgagactaatttgctgtggtgatacgccatggtgtgagattgctttgcgatgctttcccaaagccgttgttcgttcgccagatacgacaccgtagcggcggactgaatcaacacgtttacgccgctacggtgtcgtatctggcttgagggaacgaccttggtcaacgcgttgaagtcggtcgcacgagcactcct

SEQ ID NO: 18821 - RNA, 208 nt, unidentified
  source 1..208: mol_type = other RNA; note = Related to NZ_SJPM01000010.1; note = Rhodopirellula pilleata
ttcgtgaagcccaaccgagacctgtttgctgcggcgttccgccgtggtgcgagtttgcttggacatgcttccccaaggacgttgttcgtttcgccgatgacggtatctgtccggtgaactgaggcaacgtggtttcaccagacagataccgtcatcggcttggtgaacgcccttggtcgatccttcgaagtcggttgcggtttcgcga

SEQ ID NO: 18822 - RNA, 217 nt, unidentified
  source 1..217: mol_type = other RNA; note = Related to JAGQQE010000043.1; note = Planctomycetaceae bacterium
agaaggaggaagagcgactaccgagactaatttgctgcggtgttccgccgtggtgcgagtttgccttcacatgctttcccgaggtcgttgttcgttcgccagacacgtcattgtgccggcgactggagcaacgaggttttcaccagcacaatgacgtgtctggcttgagtgaacgccctcggtcggcccttcgaagtcggtactgttcatctccttc

SEQ ID NO: 18823 - RNA, 215 nt, unidentified
  source 1..215: mol_type = other RNA; note = Related to NZ_SJPW01000002.1; note = Rubripirellula tenax
gagaggagagtggacacgatcgagaccaatttgctgcggcgttccgccgtggtttgagtttgctttgacatgcttccccaaggccgttgttcgatcgccggatacaccactgtatcggcgggccgagacaacgtggttccctccgatacagtggtgtatccggctgagtgaacgaccttgggcggcgcttcgaagtcgatcgtgccgctacctct

SEQ ID NO: 18824 - RNA, 213 nt, unidentified
  source 1..213: mol_type = other RNA; note = Related to JAEUIP010000375.1; note = Planctomycetaceae bacterium
gaggggtttgggttcgaaccgagactattttgctgtggtgttccgccatggttgagtttgctttgacatgctttcccaaggccgttgttcgttggcccgaccgcgatactagtcggcggctgggacaacgggtttcctccgactagtatcgcggtcgggcttgagtgaacgtccttggtcgacgcttcgaagtcggcgcagtcctgaacccct

SEQ ID NO: 18825 - RNA, 215 nt, unidentified
  source 1..215: mol_type = other RNA; note = Related to DQCF01000782.1; note = Planctomycetaceae bacterium
caggtggggtgggcttgaacacgagactgtcctactgcggtgttccgccgcggttgaaactggcctgagattgcttcaccgtggacctgtcggcctggcccgctcaaggtctctggctgcgaccaattcgacgtggtctcgccgccagagcccagagcgggccgtacgtcagggtctgcggtcgacacttcgaagtcgcgaacactcgcccccct

SEQ ID NO: 18826 - RNA, 212 nt, unidentified
  source 1..212: mol_type = other RNA; note = Related to JAEUII010000041.1; note = Planctomycetaceae bacterium
gagaacagaacatttaccgagactaatatgctgcggtgttccgccgtggttgagtttggctcctcattgcttccccaggaacgttgttctttcggcccgaggtcatctgacccgcgcagctgagtcaacgtggttcacgcaggccagatgacctcgggcctttgtgaacgctcccggtcgacgcttcgaagtcggtgagtttgttctgttcc

SEQ ID NO: 18827 - RNA, 206 nt, unidentified
  source 1..206: mol_type = other RNA; note = Planctomycetes bacterium; note = Related to JADZDL010000180.1
gcacagcaccatgtctgagactcctctgcggcgttccgccgcggatgccctttgactgcccacgcttccccaaggtcgttgttcggtttgccgctatcgcaccgatgcgcgcctaccgagcacaggaccgaggcctttgtcgcacatcggtgcgatagcggctttggtgaacgaccttggtccatggtctgaagtcaggcgctgtg

SEQ ID NO: 18828 - RNA, 204 nt, unidentified
  source 1..204: mol_type = other RNA; note = Planctomycetes bacterium; note = Related to JAEUHU010000483.1
gcacagcccacgtctgagactcctctgcggcgttccgccgcggatgccccacgactccccacgcttccccaaggtcgttgttcggtttgccgctgccgcacctgtgcgcggcgaccgagcacagtccgaggcctttgccgcacacaggtgcggcagcggcttgggtgaacgaccttggtccatggtctgaagtcaggcgctgtg

SEQ ID NO: 18829 - RNA, 210 nt, unidentified
  source 1..210: mol_type = other RNA; note = Phycisphaerae bacterium; note = Related to CADCUQ010000908.1
cacccggtcggccggacgagaccttttctgcggcgatccgccgcgggcgacgtcggccacccatgcgaccccaaggccgttgctcgtttcggcctccggcgacagcctcgccggaccgaagcgagccgaggctctcccggcgaggctgtcgccggaggccttgagtgaacgcccttggtccgaggcgtgaagtcggccgtccggccgggt

SEQ ID NO: 18830 - RNA, 210 nt, unidentified
  source 1..210: mol_type = other RNA; note = Related to NZ_CP063458.1; note = Proposed Humisphaera borealis
ccctggtccggccggccgagaccttttctgcggcgttccgccgtggtcgcggtcggctacccatgcaaccccagacccgttgctcgtttcggcaatcgacgccaccgtcggcggaccgaaacaagcgcgaggctttcccgccgacggtggcgtcgattgccttgagtgaacggccctggtcccaggcgtgaagtcggccggccggccagg

SEQ ID NO: 18831 - RNA, 216 nt, unidentified
  source 1..216: mol_type = other RNA; note = Related to JACQZM010000063.1; note = Candidatus Riflebacteria bacterium
acggcggccttcagctgcctgagaccatcttgctgcggcgttccgccgcggtcgcgatcggcaagacatgcatccccgaggccgttgttcgttttggccacctgtgctaccgcacgggggccgaaacaagccgaggcttccccccgtgcggtagcacaggtggccttggtgaacgtcctcggtcctggtggaaagaagtcaggccgtcggccgccc

SEQ ID NO: 18832 - RNA, 216 nt, unidentified
  source 1..216: mol_type = other RNA; note = Planctomycetes bacterium; note = Related to JACPRC010000003.1
atgcgggggtcatctcccatcgagactgttctgcggtgaatcgccgcgggtgaagatggccagacgtgcgtccccggggccgttgttctttaggctgatccctccggtgcggatggactcagccaagccggggcttctccctaaccgcaccggagggatcagcctcggtgaacgtccccggtcctcggagtgaagtcggggggaatggcccccgca

SEQ ID NO: 18833 - RNA, 214 nt, unidentified
  source 1..214: mol_type = other RNA; note = Planctomycetes bacterium; note = Related to JACQFK010000217.1
cgggggccgtctccctttcgagactgttctgcggcgtaccgccgcggttgaagtcggcctcccatgcatccccggagccgttgtgctttaggctcgtccgacatctcgcgtttggactgagccaagccgaggcttttccccacgcgagatgtcggacgagcctcggtgaacgtctccggtcctgagtgcgtagtcgagagggagcacggctccc

SEQ ID NO: 18834 - RNA, 222 nt, unidentified
  source 1..222: mol_type = other RNA; note = Related to JAGQQS010000445.1; note = Planctomycetaceae bacterium
gagcagggcagagcagttttctaagaccatcctgctgcggcgatacgccgtggttgagttttctttccaattcgtccccagagtcgttgtgcgttcggccagcaattgactgccaccgggcgaccacagcaagcacaaggctttcgcccggcggcagtcaattgctggcccttgtgaacgcctctggtccgcagatcgaagttagaaaatgcctgccctgct

SEQ ID NO: 18835 - RNA, 215 nt, unidentified
  source 1..215: mol_type = other RNA; note = Related to QWOO01000305.1; note = Planctomycetes bacterium
caggagagagcaacgttctaagaccctcttgctgcggcgttacgccgtggttgatcattctttccaactcgtccccagagtcgttgctcgtttggcccgtcgcggagtgcattgcgacgaccaaaacaagccgaggctttcgtcgcaatgcactccgcgacgggccctggtgaacgcctctggtccgcagatcgaagttagacgttgcctctcct

SEQ ID NO: 18836 - RNA, 216 nt, unidentified
  source 1..216: mol_type = other RNA; note = Planctomycetes bacterium; note = Related to QWPK01000237.1
tgggagagagcagcgttctaagaccatcttgctgcggcgttacgccgtggttgattattcttcccaactcgtccccagagtcgttgttcgtttggccagctcacctagtgggctgttcgaccaagacaagcacaaggctttcgctcagcccactaggtgagctggccttggtgaacgcctctggtccgcagatcgaagttagacgttgcctctccc

SEQ ID NO: 18837 - RNA, 214 nt, unidentified
  source 1..214: mol_type = other RNA; note = Planctomycetia bacterium; note = Related to JACPHK010000356.1
cgagggagtgcaacgttctaagactttctctgcggcgttccgccgtggttgagttttctttgcatttcttccccaaggccgttgttcgtttggccggtgacgtcccgtagggcgtcgcccaaatcaagccaaaccttgcaacaccctacgggacgtcaccggccttggtgaacgaccttggtccgaggactgaagttagcacgttgcctccctt

SEQ ID NO: 18838 - RNA, 128 nt, unidentified
  source 1..128: mol_type = other RNA; note = Related to JAGQPR010000143.1; note = Planctomycetales bacterium
gtttgccggtagacgctaccgtgtcaccggccatggcgagctgtgctcaacggtgacacggtagcgtctaccggcttgagtgaacgaccttggtccgttgctgcgaagttagtagattggccaccccg

SEQ ID NO: 18839 - RNA, 215 nt, unidentified
  source 1..215: mol_type = other RNA; note = Related to SIHJ01000002.1; note = Posidoniimonas corsicana
ggggcgcgaccggctttccaagacttttctgcggcgatacgccgcgggtgagattggtaaccattgcttccccaaggccgttgttcgttagccggcaacgttaccccgtgcgccggccaagacgagccacagctcaccggcgaacggggtaacgttgccggcctgagtgaacgaccttggtccgcagccgtgaagttgggaagccggccgccccg

SEQ ID NO: 18840 - RNA, 219 nt, unidentified
  source 1..219: mol_type = other RNA; note = Related to PZKM01000007.1; note = Blastopirellula marina
cgggagcgaggtgacgattcaagactaccttgctgcggcgatccgccgtggtcgagttttgcatctcattcttccccaaggtcgttgttcgtttggccattaccgacaggtagtgcgtcgaccaggacaagccgaggctttcgacacactacctgtcggtaatggccttggtgaacgacctcggtccgcggacgtgaagttgaatcgtcacccgctccg

SEQ ID NO: 18841 - RNA, 219 nt, unidentified
  source 1..219: mol_type = other RNA; note = Related to NZ_CP083740.1; note = Bremerella volcania
cgggagcgaggtgacgattcaagactaccttgctgcggcgatccgccgcggtcgagttttgcttcccattcttccccaaggtcgttgttcgtttggccaccactaccaggtagtgcgtcaaccaggacaagccgaggcttttgacacactacctggtagtggtggccttggtgaacgacctcggtccgcagacgtgaagttgtttcgtcacccgctccg

SEQ ID NO: 18842 - RNA, 219 nt, unidentified
  source 1..219: mol_type = other RNA; note = Related to QPEV01000010.1; note = Blastopirellula cremea
cgggagcgaggtgacgactcaagactaccttgctgcggcgatccgccgtggtcgagttttgcctctcattcttccccaaggtcgttgttcggttggccactaacgacatctagtgcgtcgaccaggacaagccgaggctttcgacgcactagatgtcgttagtggccttggtgaacgacctcggtccgcggacgtgaagttgaatcgtcacccgctccg

SEQ ID NO: 18843 - RNA, 219 nt, unidentified
  source 1..219: mol_type = other RNA; note = Related to NZ_CP037423.1; note = Stieleria neptunia
ttcgagcgtggtgacgattcaagcctaccttgctgcggcgatccgccgtggctgagttttgcttctcattcgtccccaaggtcgttgttcgtttggccgacggggctacccgttccgtcgaccaaggcaagccaaggctttcgacgtaacgggtagccccgtcggccttggtgaacgacctcggtccgcagacgtgaagttgaatcgtcacccgctcgg

SEQ ID NO: 18844 - RNA, 219 nt, unidentified
  source 1..219: mol_type = other RNA; note = Related to NZ_ANOF01000123.1; note = Rhodopirellula sp.
ttagagcgaggcgacgattcaagcctaccttgctgcggcgatccgccgtggttgagttttgcttctcattcgtccccaaggtcgttgttcgtttggccaccaccgcatggtagtgcgtcgaccaggacaagccaaggctttcgacgcactaccatgcggtggtggccttggtgaacgacctcggtccgcagacgtgaagttgaatcgtcgcccgctctg

SEQ ID NO: 18845 - RNA, 204 nt, unidentified
  source 1..204: mol_type = other RNA; note = Related to JACKHI010000001.1; note = Phycisphaerales bacterium
aggccgatcacctgagactttttctgcggcgttccgccgtggttgagattggctttgcatgcatccccaaggccgttgttcgtatggcccaacgcacaccccgtgcggttggccatgacaagccgaggcttcctaccgcacggggtgtgcgttgggccttggttaacgacctcggtccggagatctgaagtcaggtgatcggcc

SEQ ID NO: 18846 - RNA, 222 nt, unidentified
  source 1..222: mol_type = other RNA; note = Burkholderiales bacterium; note = Related to JACMKE010000965.1
gagtggcgggccggccttgaccgagaccatccatactgcggcgttccgccgcggttgcgtctgcccagccatgcttccccacgaccgttgttcgtttgggcccacccgctaccgtgcgctgcggccaagacgacccaagggtcccgccgcgcacggtagcgggtgggcccttggttaacggccgcggtcctgagcgagtagtcggcaagacgacccgccact

SEQ ID NO: 18847 - RNA, 221 nt, unidentified
  source 1..221: mol_type = other RNA; note = Opitutaceae bacterium; note = Related to JADJTK010000010.1
gagtggcgggccggcgcttgctgagaccaccatgctgcggcgttccgccgcggttgcgtttgcctagccatgcttccccacgaccgttgttcgtttggcaccgcaggccactatgcgccgcggccaaaacgacccaagggtcccgcggcgcatagtggcctgcggtgccttggttaacggccgcggtcctaagcgagtagtcaacaagaccgcccgccact

SEQ ID NO: 18848 - RNA, 221 nt, unidentified
  source 1..221: mol_type = other RNA; note = Related to SLWZ01000015.1; note = Proposed Chthoniobacter flavus
gagtggcgggctggtcttcactgagaccaccatgctgcggcgttccgccgcggttgcgtttgcccagccatgcttccccaaggccgttgttcgtttggcaccgcccgctaccgtcgcgggcggccaagacaacccaagggttccgcccacgacggtagcgggcggtgccttggttaacggtctcggtcctgagcgagtagtcagtgagaccacccgccact

SEQ ID NO: 18849 - RNA, 208 nt, unidentified
  source 1..208: mol_type = other RNA; note = Planctomycetia bacterium; note = Related to JADLHC010000305.1
aggaagcggacgtctgagacaggttctgctgcggtgtttcgccgtggctgcccatgcccgtccatgcgtccccagggtcgttgttcgtgttggccggtgcgggtcctgtgcactggccatcacaagccgaggcttgcccgtgcacaggacccgcaccggccttggtgaacgaccccggtccgaaggttgaagtcagccgtccgcttcc

SEQ ID NO: 18850 - RNA, 214 nt, unidentified
  source 1..214: mol_type = other RNA; note = Related to JAIPJY010000032.1; note = Prosthecobacter sp.
gaggggacgcatgctcactgagaccatccttgcggtgttccgccgcgaatgaagctgcccgtccatgcatccccaagcccgttgttcggatggccactgtcgccacccgacgcttggccaaggcaacccgaacgttcgcacgcgtcgggtggcgacagtggcctgagtgaacggacttggtcctgagcaagtagtcagtgacgcatgcgcccct

SEQ ID NO: 18851 - RNA, 213 nt, unidentified
  source 1..213: mol_type = other RNA; note = Verrucomicrobiaceae bacterium; note = Related to JADJPW010000004.1
gaggggacgcatgctcactgagaccatccttgcggtgttccgccgcgaatgaagttgcccgtccatgcatccccaagcccgttgttcgggtggcaatcgcgtcacccagcacttggccaaggcaacccaaacgttctcacgtgcgtggtatgcgcaattgcctgagtgaacggacttggtcctgagcaagtagtcagtgacgcatgcgcccct

SEQ ID NO: 18852 - RNA, 206 nt, unidentified
  source 1..206: mol_type = other RNA; note = Related to NZ_JAALXT010000006.1; note = Rubinisphaera sp.
cggtcggtcggctgagaccaattgactgtggcgatccgccgcggttgcgttagcctacccattgccttcccagggccgttgttcgtgtggccagccccatcattggcggcggggccacagcaagccacaggctttccccgccgccaatgatggggctggcctgagtgaacgaccctggtccgccgtgagaagtcagccgaccggct

SEQ ID NO: 18853 - RNA, 202 nt, unidentified
  source 1..202: mol_type = other RNA; note = Related to NZ_JACHXU010000001.1; note = Rhodopirellula rubra
tcgttccgacgacgcgaagacctgaattgctgcggtgttccgccgtggttgaaattcgagaagcattcgcttcctcgaatcgccggtattgtcccctctccatcggtgagatgggacaatatcacgtacgtgaccatctcaccgatggagaggggacccgacgaatcgggcctcagacgcgaagttggcttcagtcggttca

SEQ ID NO: 18854 - RNA, 216 nt, unidentified
  source 1..216: mol_type = other RNA; note = Related to CP043547.1; note = Planctomycetales bacterium 10988
caggcgaagagagatagaactaagacgatttgctgcggcgttccgccgtggtcgctcatgactttccatgcttccccaaagccgttgttcgtgatccgacaccccgtctagagggagtggaccgacacgagccaaggctctccggatccctctagacggggtgtcggtgagtgaacgactttggtcctttgctagaagttagttccctcttcgctt

SEQ ID NO: 18855 - RNA, 226 nt, unidentified
  source 1..226: mol_type = other RNA; note = Related to JADLAG010000600.1; note = Polyangiaceae bacterium
gcaaggaggtccgcccgctcgagcccaacatgctgcggcgctccgccgcggtggaggttgttcttccatgcatccccacccccgatgttctttttggcgcctttgccaccggtgtcgttccactcagcggaaccagacaagtctggatctggaacgacaccggtggccggcgccttggtgatcgggtgtggtcacgagcaagtagtcgggcgggcgggcctccttg

SEQ ID NO: 18856 - RNA, 219 nt, unidentified; identical to SEQ ID NO: 18798
  source 1..219: mol_type = other RNA; note = Related to NC_010162.1; note = Sorangium cellulosum

SEQ ID NO: 18857 - RNA, 224 nt, unidentified
  source 1..224: mol_type = other RNA; note = Related to NZ_ASRX01000016.1; note = Chondromyces apiculatus
gcaaggaggtccacccgctcgagcccaacatgctgcggcgttccgccgcggtggcgttcgttctcccatgcattcccacccccgatgtgcgtctgggcgccttaggcctcgacgacaagacccagggagttgcctgacggcggaacctctcgtcgtcgaggccacggcgccctgggtgatcgggtgtggtcaggagcgagtcgtcgggcgggtgggcctccttg

SEQ ID NO: 18858 - RNA, 218 nt, unidentified
  source 1..218: mol_type = other RNA; note = Related to NZ_SSMQ01000028.1; note = Polyangium fumosum
gcaaggaggtccgtccgcccgagcccaccatgctgcggcgttccgccgtggcggagttcgttcccccatgcgtccccgcgcccgatgttcttttggccctaaagccccctaccagcatccactcagcggacccttgggtctggatgccggtagggggcctagggcctcggtgatcggacgtggtcctaggcgagtagtcgggcggacgggcttccttg

SEQ ID NO: 18859 - RNA, 218 nt, unidentified
  source 1..218: mol_type = other RNA; note = Polyangiaceae bacterium; note = Related to JADJXL010000001.1
gcaaggaggtcgttgcactcgagcccatcatgctgcggcgttccgccgtggcggagttcgttcccacatgcgtccccaccctcgatgttctttgggtaccccatgccctaggctgcgttcactcagcagacccgagggtctgaacgctgcctagggcacgggtacctgcgtgatcgagtgcggtcctaggagagatgtcgggtgcaacggcttccttg

SEQ ID NO: 18860 - RNA, 218 nt, unidentified
  source 1..218: mol_type = other RNA; note = Related to NZ_CP079217.1; note = Polyangium sp.
gcaaggaggtccgtccgctcgagcccaccatgctgcggcgttccgccgtggcggagtccgttcccccatgcgtccccacccccgatattctttgggcgcctatggtacccctccgcacccactcaagcgacccgagggtccgggtgccgaggggtacccaggcgccttggtgatcgggtgtggtccagagcgagtagtcgggtggacgggcctccttg

SEQ ID NO: 18861 - RNA, 219 nt, unidentified
  source 1..219: mol_type = other RNA; note = Related to JABBJJ010000008.1; note = Pyxidicoccus fallax
aaggagttcccttccgctcgagcccttcatgccacggtgttccgccgcggcggtggtctctctctcattcgtccccacgcccgatgttctttttgggaatcaggggcaccggcggcctgtaccagccggaccctgcgggtctcggccagccggtgcccccgattcccctcgtgatcggccgtggtccagcgtctgaagtcgggttggaagggaactcct

SEQ ID NO: 18862 - RNA, 218 nt, unidentified
  source 1..218: mol_type = other RNA; note = Related to JACPVI010000075.1; note = Myxococcales bacterium
aggaggccccgctcgcccgagcccttcagtgccgcggtgttccgccgcggcggaagtccgtctctcattcgtacccacgcccgatgctctttttggaattcacgggggtgtgacggcctgaactaatccgacccttcgggtctgggccgcacacccccgcgaattcctcggtgatcggacgtggtcaggggttcgaagtcgggcgagctggggcctcc

SEQ ID NO: 18863 - RNA, 219 nt, unidentified
  source 1..219: mol_type = other RNA; note = Myxococcaceae bacterium; note = Related to JAIBBR010000058.1
aaggaggaacctgacgaacgagtccgctatgccacggtgttccgccgtggcggcagtctgattcaccattacgtcccgacacccgatgttctttgacggaatgcaggcactacgacgctgtgtactgaatcggcccaagggcctgcagcgcgtagtgcccgcattcctccggtgatcggtcgtcgtcatagggaagaagtcgctcgtcagggtcctcct

SEQ ID NO: 18864 - RNA, 221 nt, unidentified; identical to SEQ ID NO: 18753
  source 1..221: mol_type = other RNA; note = Related to CP016211.1; note = Minicystis rosea

SEQ ID NO: 18865 - RNA, 225 nt, unidentified
  source 1..225: mol_type = other RNA; note = Related to JADJRH010000011.1; note = Polyangiaceae bacterium
tcaaggagcttcgatcccccgagtccatccagccgcgatgttccgtcgcggcggccgttcgtctaccatgcgtaccctcgcccgatattctttttggcacccagaccacctctcgtacgtgcactcaggggagacgccgagtcgtctctccgtacgagaggtggtcgggtgccttcgtgatcgggcgtggtcctcgggaagtcgtcgggggatcgaagttccttc

SEQ ID NO: 18866 - RNA, 217 nt, unidentified
  source 1..217: mol_type = other RNA; note = Related to JAFEBD010000111.1; note = Deltaproteobacteria bacterium
gcaaggaggcccgagcgcacgagcccatcatgctgcggcgttccgccgtggcggctgttgctgtctcatgcttccccacgcccgatgttcttttgggctcgccgcgtgctgtctcgctccaccagagcgacagatgtctgtatcgacgacagcacgcgcgagcccttggtgatcggacgcggtcctacgcacgaagtcgagcactcgggcttccttc

SEQ ID NO: 18867 - RNA, 217 nt, unidentified
  source 1..217: mol_type = other RNA; note = Related to NZ_CP012333.1; note = Labilithrix luteola
gcaaggaagtccgagcgcacgagaccatcatgctgcggcgttccgccgtggcggccgttgcttctccatgcttccccacgcccgatgttcttttgggctcgcagggtgccgtgtcgtttcaccagggcaacagatgtttgctccaaacacggcaccccggagcccttcgtgatcggacgcggtcctacgcacgaagtcgagctctcgggcttccttc

SEQ ID NO: 18868 - RNA, 218 nt, unidentified
  source 1..218: mol_type = other RNA; note = Deltaproteobacteria bacterium; note = Related to JACRCQ010000074.1
aaggaggtccgatcgcacgagcccgtcatgctgcggcgttacgccgtggcggagtctgctctaccatgcatccccacgcccgatattcttttgggcccaggggtgcccacacaccatcctgagtcgacatcaagagtcgctggttgtgtgggcacgccccgggccctcggtgatcggacgcggtccttcgcacgaagtcgagcgcaatcgggcctcct

SEQ ID NO: 18869 - RNA, 221 nt, unidentified
  source 1..221: mol_type = other RNA; note = Related to JADZES010000060.1; note = Deltaproteobacteria bacterium
ccgaggaggaccgagctctccgagcccatgatgctgcggcgctccgccgtggcggacattgctgatcattgcttccccacacccgatgttcttttgggcgccttttgccactacagtgctgcaccaaggcaactccgcggagtttccagcaccgtagtggctcggcgcctgggtgatcgggcgtggtccctagcgagaagtcggtggctcggtcttcctcg

SEQ ID NO: 18870 - RNA, 223 nt, unidentified
  source 1..223: mol_type = other RNA; note = Related to JAEUKI010000057.1; note = Myxococcales bacterium
ccaggaggtcgcgaacacccgagcccacaattcccggtgatccgccggggtgagagaaagctctttcatgcgtcccaacgctcgctgctcttttgcgcgcccatcacccatggtgggacccgccagggcaacgctgcgcgttcggctcccaccatgggtgcgggcgcgctttggttagcgatcgttgtcaggagctggaatgtcgggtgttcgcggcctcctg

SEQ ID NO: 18871 - RNA, 241 nt, unidentified; identical to SEQ ID NO: 18724
  source 1..241: mol_type = other RNA; note = Related to NZ_CP011125.1; note = Sandaracinus amylolyticus

SEQ ID NO: 18872 - RNA, 227 nt, unidentified
  source 1..227: mol_type = other RNA; note = Related to JAFLCL010000034.1; note = Deltaproteobacteria bacterium
cgagtgagaggtgaaggcacgagccctcatgctgcggcgttacgccgtggtcgacgttggccttccattgctcacccacgcccgttgttcttttcggtacctgcactagctgtcgttggcaccgaggagagcggcgcgagcggcgctctgccaagcgacagctagtgcaggtaccgtcgtgaacggacgtggtccaggggtagaagtcgagctttcacctctctctc

SEQ ID NO: 18873 - RNA, 227 nt, unidentified
  source 1..227: mol_type = other RNA; note = Sandaracinaceae bacterium; note = Related to JAIBCE010000038.1
ggagtgagaggagcgaggcacgagccctcatgctgcggcgttacgccgtggtcgacgttggccttccattgctcacccacgcccgttgttcttttcggcgcccgcgctagctgtcgttggcaccgaggagagcccgcgagcggagccctgccaagcgacagctagcgcgggcgccgtcgtgaacggccgtggtccagggatagaagtcgagcttcctcctctctctt

SEQ ID NO: 18874 - RNA, 221 nt, unidentified
  source 1..221: mol_type = other RNA; note = Acidobacteria bacterium; note = Related to JADLFP010000335.1
ggagggaggccccgttccccgagaccatccatcctgcggtgttccgccgcgggcgcccgggctctcccatgcttccccacacccgatgttcttctgggctccggcagcctctgccggactccactgaggcaacccgagggtttgaggtccggcagaggctgccggagcctcggtgatcgggcgtggtccgccgtgagaagtcggggatcggggtttccttc

SEQ ID NO: 18875 - RNA, 235 nt, unidentified
  source 1..235: mol_type = other RNA; note = Related to PABA01000104.1; note = Sandaracinus sp.
tcgaggaggtctgcgagcacgagcccatcatgctgcggcgctacgccgtggcggagcttcgctacccacccgaccccgcgcccgatgctctgggttggcgccgccgacggcatgcgcctgtcccaagggcaacgcggtaggctgcgcctaccacgtcgacaggcgcatgccgtcgcggcgccgtgggtgatcggacgcggtcccgagcacgaagtcgagctggcagacctcctcg

SEQ ID NO: 18876 - RNA, 229 nt, unidentified
  source 1..229: mol_type = other RNA; note = Related to JADZAM010000038.1; note = Sandaracinaceae bacterium
cgagggagagcctcacgcacgagcccacatgccgcggtgctccgccgcggtggagattgctctcccatgctttcccacgcccgatgttcttggtgggcgccacgcgtgcctaccgcgaacaccaagggcgacccccgcgatgcgggagtccgttcgccgtaggcacgcgtggcgccctcggtgatcggacgtggtcctcggtgagaagtcgagcgtggggctctccctc

SEQ ID NO: 18877 - RNA, 224 nt, unidentified
  source 1..224: mol_type = other RNA; note = Related to SHBB01000309.1; note = Sandaracinaceae bacterium
ggagagactctcgggaggaccgagcccaacatgccgcggcgttccgccgtggtggaggtttgccttccattcactcccacgcccgatgttctgttgggggcacaggtcccctgcagcgctcacgaagggcgactcgggagagtctgagcgccgcaggggacccgtgccccctgggtgatcggacgtggtcctcggaccgagagtcgatctctcgagagtctctc

SEQ ID NO: 18878 - RNA, 217 nt, unidentified
  source 1..217: mol_type = other RNA; note = Related to JACKEC010000023.1; note = Sandaracinaceae bacterium
acgtaccgagacgagaccgagctcatcatgccgcggcgttacgccgcggtggaggttgcccttccatgctctcccacgtccgatgttcgtttggggctgccgtgccccgtgcgcgaacacgagagacgaatcgggagattctgttcgcgcacggggcacgcagccccttggtgatcgaacgtggtccacggacagaagtcgatctccgatgggtacg

SEQ ID NO: 18879 - RNA, 222 nt, unidentified
  source 1..222: mol_type = other RNA; note = Related to JADJGV010000002.1; note = Myxococcales bacterium
gcaaggagatccgcgcgcacgagcccactatgctgcggcgttccgccgtggcgggacttgctccaccattgctcacccacgcccgattttcttttgggccctatgcggtgctagcgctcctcactgagacgaccacgagagtcttgggagccgctagcaccgccgggccctcggtgatcggtcgcggtcctgcgcacgaagtcgagcgagcggatctccttg

SEQ ID NO: 18880 - RNA, 219 nt, unidentified
  source 1..219: mol_type = other RNA; note = Polyangiaceae bacterium; note = Related to JABFYI010000076.1
ccaaggagccacgctcccccgagcccatcatgctgcggcgctccgccgcggtggctgtttctccgcattgcatcccgacgcccgattttcgtggggccgccatcacaggtaggacatgtcacgcagacaacccgagggtttgtcatctcctacctgtgcggctggccttggtgatcggacgtcgtcgtaagtgagtcgtcgagggagcgtggttccttg

SEQ ID NO: 18881 - RNA, 220 nt, unidentified
  source 1..220: mol_type = other RNA; note = Polyangiaceae bacterium; note = Related to JABFXY010000131.1
ccaaggagcctcgctcccccgagcccatcatgctgcggcgctccgccgcggtggccgtatctctgctttgcatcccgacgcccgatgttctgggggccgccaagtcctgcagtcgcgttcacgaaggcaaccacgagggtttgcacgtgactgcaggaccggctggccttggtgatcggacgtcgtcgtcagtgagtcgtcgagggagcgaggttccttg

SEQ ID NO: 18882 - RNA, 215 nt, unidentified
  source 1..215: mol_type = other RNA; note = Related to JAEUKE010000177.1; note = Myxococcales bacterium
caggagcctcgctcccccgagcccatcatgctgcggcgctacgccgcggtggctgtttctctgcattgcatcccgacgcccgattttcgtggggccgccatgtcctaccgtagcgttcacgaaggcaaccccagggtttgctcgccacggtaggaccggctggccttggtgatcggacgtcgtcgtcagtgagtcgtcgagggagcgaggttcct

SEQ ID NO: 18883 - RNA, 215 nt, unidentified
  source 1..215: mol_type = other RNA; note = Related to JACQYO010000047.1; note = Deltaproteobacteria bacterium
tcgaggagaccgggtcgcacgagcccactatgccgcggcgttccgccgcggtggagcttgctatctcgtgctttcccacgcccgttgttcttgggcgccggatcgacaccgtcgtccgcatactcagtcgacgtatctcgctcgacgacggtgtcgatccggctcggtgaacggacgtggtccttcgtatgaagtcgggcgacccggcctcctcg

SEQ ID NO: 18884 - RNA, 215 nt, unidentified
  source 1..215: mol_type = other RNA; note = Deltaproteobacteria bacterium; note = Related to JACPFK010000116.1
tcgaggaggtcgggccgcacgagcccaccatgccgcggtgttccgccgcggtggagattgctacctcgtgctttcccacgcccgttgttcttgggcgccggatcgacatccacgtccgcatactcagtcgacgtatctcgctcgacgtggatgtcgatccggctcggtgaacggacgtggtccctcggttgaagtcgggcgtcccgacctcctcg

SEQ ID NO: 18885 - RNA, 213 nt, unidentified
  source 1..213: mol_type = other RNA; note = Related to JADJBV010000001.1; note = Deltaproteobacteria bacterium
aggagaggatccggacgttcgagtccatgatgccgcggtgttccgccgcgacggagtttgcctgccattgcttccccacgcccgttgttcttttgcgggacgcactgcctgtcttcctgactcattcgacgggtctcgtaatgacaggcagtgcgtcccgctcggtgaacggacgtggtcctcggaaagaagtcgggcgtccggatcctctcc

SEQ ID NO: 18886 - RNA, 220 nt, unidentified
  source 1..220: mol_type = other RNA; note = Related to JACKED010000002.1; note = Sandaracinus sp.
aggaggagattcaccgaaccgagcccaccatgccgcggtgttccgccgcggtggcgattggtcttccatgcttccccacgcccgatgctcttgggtggcgccgacacacagcgccaccggacaccagagcgacccaagggtctgccgcccgcgctgtgtgcggcgccatgggtgatcggacgcggtccttcgcgagaagtcggttcggtgagtctcctct

SEQ ID NO: 18887 - RNA, 150 nt, unidentified
  source 1..150: mol_type = other RNA; note = Related to NZ_JAHXBF010000024.1; note = Hyalangium sp.
agggggacctggcctcgcagacgagccgtttgtgccgcggtgtttcgccgcggcggcatcttgtccccatcacatcgccgcgggcccagcgtacggaacgcagggctccacgagtccagggcctcgcaagtcgtccagtcccggtcccct

SEQ ID NO: 18888 - RNA, 150 nt, unidentified
  source 1..150: mol_type = other RNA; note = Related to NZ_JMCB01000011.1; note = Hyalangium minutum
agggggtccgggcctcgcagacgagccgttcgtgccgcggtgtttcgccgcggcggcttcttgtccccatcacatcgccacggtcccagcgtacgcaacgctgggatccccgagtccagggcctcgcaagtcgtccccgcccggtcccct

SEQ ID NO: 18889 - RNA, 148 nt, unidentified
  source 1..148: mol_type = other RNA; note = Myxococcaceae bacterium; note = Related to JAEUJQ010000080.1
gtggggacggtgggtgcagccgagccagttgaaccacggtgcttcgccgtggtggcgccttgccttcatcaccacgccagggtccccacgtacgcaacgcggggagcccagggtccagagcctcgcaggtcgacccctgccggcctca

SEQ ID NO: 18890 - RNA, 146 nt, unidentified
  source 1..146: mol_type = other RNA; note = Related to QFQP01000022.1; note = Archangium gephyra
ttggggagacaggcgcagccgagccagttgaaccacggtgtttcgccgtggtggtgccttgtttccatcacttcgccagggtccccacgtacgcaacgcggggagccccgggtccacagcttcgcaggtcgactcctgtcgcctca

SEQ ID NO: 18891 - RNA, 148 nt, unidentified
  source 1..148: mol_type = other RNA; note = Deltaproteobacteria bacterium ADurb.Bin207; note = Related to MWCO01000010.1
tctcggaagcgctttgcagaaccagcctctcatgctgcggtgtttcgccgcagtggaatgttgcctcctttccaccgccacggtccccacgtgcgtaacgtggggagccatggtgccagagcctcgaagtggttcaggcgattccggg

SEQ ID NO: 18892 - RNA, 221 nt, unidentified
  source 1..221: mol_type = other RNA; note = Related to NZ_CP011509.1; note = Archangium gephyra
cggcggtcagggggcagtaccttgcaatccggacggtgtttcgccgtccatgcttcctggcctgtcatgcatcactggcccgctcttcactgtgcggtacctccctcctggtgacggcagcgctgtcgaccgcgtcggtcctgcgcgtcaccaggagggggtaccgcttgagttgagacggtccagtcccgagagcagtacgaaggagctctctgaccgcc

SEQ ID NO: 18893 - RNA, 152 nt, unidentified
  source 1..152: mol_type = other RNA; note = Verrucomicrobia bacterium; note = Related to JAFLEF010000003.1
ataagatccggcggacagagattagccatccatgccacggtgtttcgccgtggtggaccactgcccgacatacttcgccagggttcccaacgttcgcaacgctgggaggccctgagtccagagcctcggaagtaatccgccgccgggtctta

SEQ ID NO: 18894 - RNA, 152 nt, unidentified
  source 1..152: mol_type = other RNA; note = Verrucomicrobia subdivision 3 bacterium; note = Related to WRPG01000015.1
ataaggcccggcggacatgggttagccatcattgccgcggtgtttcgccgcggtggaaacttggtagccatacatcgccagggttccctacgttcgcaacgcagggaggccctgagtccagagcctcggaagtaatccgccgccgggccttg

SEQ ID NO: 18895 - RNA, 152 nt, unidentified
  source 1..152: mol_type = other RNA; note = Verrucomicrobia bacterium; note = Related to JAFEGM010000010.1
agcaggcccggcggactcggattagccaccattgccgcggtgtttcgccgcggtggaaatctgtctgcatgtcatcgccaaggctcccagcgtgcgcaacgccgggaggccctgagtccagagcctcggaagtgatccaccgccgggcctgc

SEQ ID NO: 18896 - RNA, 152 nt, unidentified
  source 1..152: mol_type = other RNA; note = Related to JACSRI010000083.1; note = Opitutaceae bacterium
acaaggtccgccggttcacggccagccatccatgccacggtgtttcgccgtggcggttcgttgtctccattactccgccagggctcccaacgttcgaaacgctgggaggcccagagtccagagcctcgcaagtgaccggccggcggaccttg

SEQ ID NO: 18897 - RNA, 150 nt, unidentified
  source 1..150: mol_type = other RNA; note = Related to NZ_CP036275.1; note = Maioricimonas rarisocia
cagcagatccgatcgtgcaaccagccttcatgccgtggtgtttcgccgcggcggcgcattccgctcatcacatcgccacgggttcccacgtacggaacgtgggagcccatgagtccagagccttgcaagtggttttccgccggaccggtt

SEQ ID NO: 18898 - RNA, 149 nt, unidentified
  source 1..149: mol_type = other RNA; note = Related to DTTU01000358.1; note = Phycisphaerales bacterium
tccgagcccgagagatgcaaccagccgcctatgctccggtgtttcgccggagtggagtccttgactcatcacatcgccacggttcccagcgtacgaaacgcgggaggccgcgagtccatagccttgcaagtggagcctctcgggctcgg

SEQ ID NO: 18899 - RNA, 152 nt, unidentified
  source 1..152: mol_type = other RNA; note = Alphaproteobacteria bacterium; note = Related to JAGOBA010000003.1
cccggatcggggcaggttgctccagcttccaacgccacggtgtttcgccgtggttgcttcctgatcccattacatcgccacggttccccacgtacgaaacgtggggaggccacgggtccagagccttgtgggtggtgcaccgcccgatccgg

SEQ ID NO: 18900 - RNA, 152 nt, unidentified
  source 1..152: mol_type = other RNA; note = Related to JABFRX010000136.1; note = Alphaproteobacteria bacterium
cccggatcgaggctggccgttccagcttccaacgccacggtgtttcgccgcggttgccttttgatcccattacatcgccacggctcccatcgtacgaaacgacgggataccacgggtccagagcttagtgggtggatggcggccttgtccgg

SEQ ID NO: 18901 - RNA, 151 nt, unidentified
  source 1..151: mol_type = other RNA; note = Related to JAFMSC010000026.1; note = Hyphomicrobiaceae bacterium
cccgggtctggcagggccttccagcttcctttgccacggcgttccgccgtggtggcctgctactcccatcacatcgccacggctccccacgtacgaaacgaggggaaaccacgggtccaaagccttgttggtggttggccggccggcccgg

SEQ ID NO: 18902 - RNA, 152 nt, unidentified
  source 1..152: mol_type = other RNA; note = Proteobacteria bacterium; note = Related to JAFECH010000062.1
cccggacctgataggatcatccagctttccatgccacggtgtttcgccgcggtggctacctgatcccatcacatcgccacggttccccacgtacgaaacgcggggaggccacgggtccaaagccttgtttgtgggtgttccttcagattcgg

SEQ ID NO: 18903 - RNA, 150 nt, unidentified
  source 1..150: mol_type = other RNA; note = Bradyrhizobiaceae bacterium; note = Related to JAFMSG010000097.1
gcggggcggtacttcaatatccagcaattaacgccacggtgcttcgccgtggttgcgtgttatctccttcacttcgccaaggtccccgacgtacgaaacgcggggagccctgagtccagagcctcgttagtggttaggagtgccgccccg

SEQ ID NO: 18904 - RNA, 152 nt, unidentified
  source 1..152: mol_type = other RNA; note = Planctomycetes bacterium; note = Related to JAAZAJ010000036.1
gccgggcccggcggcctgcaaccagccgatgataccgcggtgtttcgccgcggtggcaaagtgagccgttcacgccgccacggctcccagcgtacgcaacgccgggaggccacgagtccagagcctcgcaagtggttccgcgtcgggctcgg

SEQ ID NO: 18905 - RNA, 150 nt, unidentified
  source 1..150: mol_type = other RNA; note = Planctomycetes bacterium; note = Related to QQVE01000048.1
tccgggcccggcgaactgcaaccagccgttcgtgccgcggtgcttcgccgcggtggcactctgcatgtattacgccgccacggctcccacgtacgaaacgcgggaggccatgagtccagcgccttgcaagtggttcggcgccgggctcgg

SEQ ID NO: 18906 - RNA, 152 nt, unidentified
  source 1..152: mol_type = other RNA; note = Related to JAGQOZ010000372.1; note = Planctomycetales bacterium
gttcgaacccggtggcttgcaaccagccaacgatactgcggtgcttcgccgcggtggcttgctgcgtgtattacgccgccacggctcccacgtacgcaacgtgggaggccacgagtccaaagccttgcaagtggtgcactgccgggttcgaa

SEQ ID NO: 18907 - RNA, 148 nt, unidentified
  source 1..148: mol_type = other RNA; note = unidentified bacterium; note = Related to WGNR01000010.1
cgggcctggcgtgcgtgcaaccagccaacgatgccgcggtgtttcgccgcggtggcctgctgcgtccttaacgccgccacagatcccgtcgtacgaaacgatgggagccacgattccagagccttgcaagtggttcgccgccaggctc

SEQ ID NO: 18908 - RNA, 149 nt, unidentified
  source 1..149: mol_type = other RNA; note = Pirellulales bacterium; note = Related to JAFGFF010000467.1
ccgggcctggcgggctcgcaaccagccaactatgccgcggtgtttcgccgcggcggcatgctgcgtccataacgccgccacggctcccacgtacgcaacgtgggaggccacgagtccaaagcctcgcaagtggttccccaccaggcccg

SEQ ID NO: 18909 - RNA, 152 nt, unidentified
  source 1..152: mol_type = other RNA; note = Proteobacteria bacterium; note = Related to PSQY01000124.1
agagggcacgctggcgtgcaaccagccgggaatgccccggtgtttcgccggggcggcgctttgagcgcattacctcgccacggctccccacgccgcagacgcagggagaccatgagtccagagccttgcaagtggtcggctggcgtgtcctc

SEQ ID NO: 18910 - RNA, 149 nt, unidentified
  source 1..149: mol_type = other RNA; note = Planctomycetes bacterium Pan216; note = Related to CP036279.1
tccggcccttgggcagcgcaattagccgtgatcctacggtgtttcgccgtgggggagtattgggtctcttcacaacgccgcggatcccacgtacgtaacgtgggaagccacgagtccagagcctcgcaagtgattggttcgagggccgg

SEQ ID NO: 18911 - RNA, 129 nt, unidentified
  source 1..129: mol_type = other RNA; note = Armatimonadetes bacterium; note = Related to JACQGK010000369.1
tcgcccaggctagccatcctcccggtgtttcgccggggcggcaccctgtgcccactacatcgccaagctccccatcgcacgaaacgacggggaaagcccgagtccagagcctcgcaagtagcctgggcc

SEQ ID NO: 18912 - RNA, 152 nt, unidentified
  source 1..152: mol_type = other RNA; note = Related to QWHO01000540.1; note = bacterium CPR1
gggaaggctggctcgccagagttagccaacgattccacggtgtttcgccgtggaggcgcattgtcgccatcacgtcgccaaggtccccatcgtgccaaacaatggggagccctgagtccagggcctcgcaggtagcctcgggccagctttcc

SEQ ID NO: 18913 - RNA, 150 nt, unidentified
  source 1..150: mol_type = other RNA; note = Related to JADMJV010000021.1; note = unidentified bacterium
agagtggaatcggaaaatagttagccatctatgctgcggtgtttcgccgcagcggcacattgctgccataacaccgccaaggtccccatcgtacgcaacggcggggagccctgagtcctgggcctcgttagtaacttgcccattccaccc

SEQ ID NO: 18914 - RNA, 150 nt, unidentified
  source 1..150: mol_type = other RNA; note = Related to NZ_BLJN01000007.1; note = Steroidobacter agaridevorans
gcgtcgcccggcggcctgcagctagccatctgtccctggtgtttcgccagggcggcgccttgagcgcattacttcgccacggtccccacgtacgtaacgcggggagccatgagtccacggccttgcaggtagccttgccgccgggcaatt

SEQ ID NO: 18915 - RNA, 143 nt, unidentified
  source 1..143: mol_type = other RNA; note = Related to SADD01000012.1; note = Lujinxingia sediminis
agggtgagccacccggcgcgagccgaacatgccgcgtgcgtttcgccgcggcggcaccatcttccgatctcctcgccggttctcccacactgtggaagaagcgggcccagagcgtcgcaggtcgcctcgcaggtggctcaccc

SEQ ID NO: 18916 - RNA, 143 nt, unidentified
  source 1..143: mol_type = other RNA; note = Related to NZ_VOSM01000004.1; note = Lujinxingia vulgaris
agggtgagccaccgcgcgcgagccgaacatgccgcgtgcgattcgccgcggcggcaccatcttccgatctcctcgccggttctcccacactgtggaagaagcgggaccagagcgtcgcaggtcgcctcgctggtggctcaccc

SEQ ID NO: 18917 - RNA, 141 nt, unidentified
  source 1..141: mol_type = other RNA; note = Related to NZ_QHKO01000004.1; note = Lujinxingia litoralis
gagcggtcaccggtcgcgagccagcttcagccgcgtgcgtttcgccgcggcggcaccatcctccgatctcctcgccggttttcccacactgtgggaaaagcgggcccagagcgtcgcaggtcgccctggccggtgactcct

SEQ ID NO: 18918 - RNA, 149 nt, unidentified
  source 1..149: mol_type = other RNA; note = Related to QWHC01000005.1; note = Chloroflexi bacterium CFX4
tcgcacagcaagcgacgcggttagccaacatgctgcgatgtcccgtcgcggtggcaaactgtgcaggtcacttcttcacggctcccacagctcggacaagcgtgggaaccgctccatcacggagatcgtagccgcctgcttgctgtgtg

SEQ ID NO: 18919 - RNA, 136 nt, unidentified
  source 1..136: mol_type = other RNA; note = Related to JADYYJ010000076.1; note = Anaerolineae bacterium
tgaatgcgatgcggttagccattatgctgcgatgttacgtcgtggtgggatgctgaccagatcacgtcttcacaggtacccactctcgaacaagcgggtacctgctccaagatttgaaagtaaccgcatcgccctc

SEQ ID NO: 18920 - RNA, 154 nt, unidentified
  source 1..154: mol_type = other RNA; note = Anaerolineaceae bacterium 4572_78; note = Related to NBMH01000138.1
agggtagcttggttagccgattctgcgatggcacgtcgtggaggcgaattgttcaccacacttcttaatttaatcaccgagtgattaaattacttatgtcaaggttacgtgtaaccttgacataaggttcagtatgttagtaaccaagttaccc

SEQ ID NO: 18921 - RNA, 134 nt, unidentified
  source 1..134: mol_type = other RNA; note = Ardenticatenales bacterium; note = Related to JACCSL010001044.1
ggggtggcccggttagcccttcatactgcggcgttccgccgtggtggagttgtctagccaacccttctgctcaggttcctaccctacgaacaaggtaggagccgcttcaccgcttgttcgtaaccgggccatcc

SEQ ID NO: 18922 - RNA, 138 nt, unidentified
  source 1..138: mol_type = other RNA; note = Related to PSQZ01000251.1; note = Chloroflexi bacterium
cggcagcccggcatagccatttatgccgcggtgttacgccgtggtggagtactagcaccatcactccttcgccggtccacccagctttcgcacaagcgggtggaccgctccgggggctcgaacgtacgccgggctgtc

SEQ ID NO: 18923 - RNA, 221 nt, unidentified
  source 1..221: mol_type = other RNA; note = Related to NZ_CP069396.1; note = Archangium violaceum
cggcggtcagggggcagtaccttgcaacccggacggtgtttcgccgtccatgcctcatggcctgtcatgcatcactggcccgctctttactgtgcgcggcctccctccctgtcgccgcagcgatgtcgacctcgtcggtcctgcgcgcgacagggagggggccgcgcttgagttgagacggtccagtcccgagagcagtacgaaggtgctctctgaccgcc

SEQ ID NO: 18924 - RNA, 158 nt, unidentified
  source 1..158: mol_type = other RNA; note = Related to NZ_WJIE01000006.1; note = Polyangium spumosum
ggctcacgggaggcgcgagcagccagctatcaccccgcgatgtcacgtcgcggctgcgaacgactccccatggagaatgaagcgtcacggggaccgccccgcagggcttttcgtccccgtacgcctctgccgagcaggtggcgacgcctcccgtgagc

SEQ ID NO: 18925 - RNA, 218 nt, unidentified; identical to SEQ ID NO: 18860
  source 1..218: mol_type = other RNA; note = Related to NZ_CP079217.1; note = Polyangium sp.

SEQ ID NO: 18926 - RNA, 256 nt, unidentified; identical to SEQ ID NO: 18790
  source 1..256: mol_type = other RNA; note = Related to NC_020126.1; note = Myxococcus stipitatus

SEQ ID NO: 18927 - RNA, 148 nt, unidentified
  source 1..148: mol_type = other RNA; note = Related to JAACJQ010000343.1; note = Archangiaceae bacterium
ccggagtcgtgttcggctagccatctccgcgatgtcacgtcgcgggtgaacacgattcaccatgaagaatgaattggcgcgtgagtcgcctcgcggcttcttcactcatgctctcctctgcaggcaggtaacctcaagcgcgactccg

SEQ ID NO: 18928 - RNA, 153 nt, unidentified
  source 1..153: mol_type = other RNA; note = Related to JACCSS010001187.1; note = Deltaproteobacteria bacterium
tccccggagtgtggtcgagctagccttctgtcgatggtggtacgccatcgctgacaacgaccgaccatgaaacacgaagaggtgcgtggcttcgttgcctctccacacagccataccctcctctgccgagcgagtagacgccacgctccgggg

SEQ ID NO: 18929 - RNA, 152 nt, unidentified
  source 1..152: mol_type = other RNA; note = Myxococcales bacterium; note = Related to JAEUKA010000036.1
gttccttcgatcgctccgcagttagcttcctccgcgatgttacgtcgcggttgctttcgacctgcaatggacaatgcgctggtccgagctgccgcttgcggcttttctcagctcggtcaccgctgccacgcaagtagctgcgatcgaaggag

SEQ ID NO: 18930 - RNA, 154 nt, unidentified
  source 1..154: mol_type = other RNA; note = Myxococcales bacterium; note = Related to JAEUKB010000029.1
cgttccttcgatcgccacgcagttagcttcttccgcgatgctacgtcgcgggtgcgtacgacctacaatggacaatgcgctggaccgagctgccgcttgcggcttttctcagctcgggcaccgctgccacgcaagtagctgcgatcgaaggaac

SEQ ID NO: 18931 - RNA, 248 nt, unidentified
  source 1..248: mol_type = other RNA; note = Related to JABJWV010000001.1; note = Pseudenhygromyxa sp.
taggagccccgggatcatcagccgtgctcagcacagggcggcgccgcgccgtccgggcaaattctcccgacatgctccacaaggtaggctgttcgtgctttccctggccccgtagaggtcgtagacgacctcgtggctggggctaccacgcaaccgcggttcacgaggtcgtctacgacctctacggggccggaaagcggtgagcctaccgtgtcccaggtgggatcgtggcgacttcggtcgctcct

SEQ ID NO: 18932 - RNA, 213 nt, unidentified; identical to SEQ ID NO: 18749
  source 1..213: mol_type = other RNA; note = Related to NZ_JAGKQQ010000001.1; note = Gemmata sp.

SEQ ID NO: 18933 - RNA, 160 nt, unidentified
  source 1..160: mol_type = other RNA; note = Related to JAIOPV010000289.1; note = Planctomycetes bacterium
attcacggttcgcggttgaagttagcgaaaaccacggtgttacgccgtgggtggttttcagtgccgaccagttcagatcgggtctactccgagactcgcaccaggggcggtctcggagcagaccgtgccgcaggaggaaagtagccccgcgatccgtgag

SEQ ID NO: 18934 - RNA, 212 nt, unidentified
  source 1..212: mol_type = other RNA; note = Related to LR594584.1; note = Gemmataceae bacterium
acggtgtccgtcgcggtccgagaccaccatgctgcgatgttccgtcgcggttgaagttgctcgcgattgcgtcccccgagccgttggtcttttcgcccggtcagggctccctggactgggctgaatcgacctgcgtccccagtccagggagccctgaccgggcggcgtgaacgtctcgggtcccggatcgaagtcggccgcggcggacaccg

SEQ ID NO: 18935 - RNA, 155 nt, unidentified
  source 1..155: mol_type = other RNA; note = Gemmataceae bacterium; note = Related to JAIEMG010000136.1
agtttccgtccgcaccggaggtagcgacatctgcggcgttacgccgtgggaggtttgcagtgcccgccggtcaagacggtgtgcctgttccatacaggtatggaccaggcgcaccggtgcccataggaggtaagtagctcggtgcgggcggaaac

SEQ ID NO: 18936 - RNA, 150 nt, unidentified
  source 1..150: mol_type = other RNA; note = Related to JAEUIF010000053.1; note = Planctomycetia bacterium
gttccgcccgcgctggaggtagcgctgactgcggcgttacgccgcggatggacactacttgtgccaagcaagaacgtccacccgggcctctacagatagggcccgggcggacagggcctatcggaggtaagtagctcggcgcgggcggaa

SEQ ID NO: 18937 - RNA, 164 nt, unidentified
  source 1..164: mol_type = other RNA; note = Related to VGYW01000017.1; note = Planctomycetes bacterium
cggaagggcggggagagagctttagccgacacgcaagtgtcgctgcggcgttacgccgcggacgtgccctagctcgcttcacgccagcagaatattccagtggtcgttccgaccactgaaatattcggcgcaggagagcgacgtaaagccctccccgccccccg

SEQ ID NO: 18938 - RNA, 224 nt, unidentified
  source 1..224: mol_type = other RNA; note = Planctomycetes bacterium; note = Related to SOJX01000071.1
ccggcggggaccggccgaactttagctcgtgcgtaaccaatcgcaaccgcggcgttccgccgcggatggagtatcgcaacccttcgcttctacggatgtccgcaaggtcggaagaccttgcaagcaaggtcttccgaccttgcgacatccgtgcagctcgtggggttatttatcgaaaacaagttttcgataaataacccctggtaaagtaccggtccccgccg

SEQ ID NO: 18939 - RNA, 120 nt, unidentified
  source 1..120: mol_type = other RNA; note = Desulfobacteraceae bacterium 4484_190.1; note = Related to MVDA01000360.1
ctgatgccggagcctgaattttagcttttcgtatggtgttacgccatgcaagcctgtcaccttgcttcgcacagccgcgagctatctcccggctgttatagtaaatcggctccggcgtca

SEQ ID NO: 18940 - RNA, 157 nt, unidentified
  source 1..157: mol_type = other RNA; note = Related to MHBH01000069.1; note = Lentisphaerae bacterium GWF2_49_21
tgacggagcggcagtagatttttagatcgtgcgcggtgtttcgccgcgcttgcgttactacccggcttagtccaaggagattaaaaattctttttaatctccatggactataaatggctatgccatatggttgacaagtaaaaactgccgctccgtc

SEQ ID NO: 18941 - RNA, 159 nt, unidentified
  source 1..159: mol_type = other RNA; note = Planctomycetes bacterium; note = Related to JAFGPY010000175.1
ggccgaggcggccgatcggattagtcatggggcggcgtttcgccgtccaagccggttacatcttcactgccgtccgcggcgctccaccggttgaggctgatgctcaaccgccggcgccgcggggttcggatcggatagtaatcacgcggtcgcctcggc

SEQ ID NO: 18942 - RNA, 132 nt, unidentified
  source 1..132: mol_type = other RNA; note = Planctomycetes bacterium; note = Related to JAADGH010000108.1
aggtggcgggccgagagagttttagatttgtgcggcgattcgccgtgcgtgcgctttgcgccatcaaccagcctttgttcctgctgagagcaggaacgcagaatggatgcatagtaaaaccggtccgccacc

SEQ ID NO: 18943 - RNA, 150 nt, unidentified
  source 1..150: mol_type = other RNA; note = Planctomycetes bacterium; note = Related to JAFGGJ010000038.1
gcgacgggagggagacaggcttagaacgcgtgcggcgtttcgccgcgccggtgtacgcctttttccaacggctcgatcggagtcggaggataacgcgttatccaccgctccggagcataagcaggctcaggtaagtgctccctcccgccc

SEQ ID NO: 18944 - RNA, 171 nt, unidentified
  source 1..171: mol_type = other RNA; note = Deltaproteobacteria bacterium; note = Related to JAGOOG010000002.1
agaagggcagtcggtaaatgcttagatcgtcgcggcgtttcgccgtggttgccgcatctacagaacatactgccaatgccgcatgagtcaccacaggcctgcggccacatggtgattcatgtggcagtgtcgattcatagtaatgcttagtaaggtgaccgactgtccttc

SEQ ID NO: 18945 - RNA, 188 nt, unidentified
  source 1..188: mol_type = other RNA; note = Planctomycetaceae bacterium; note = Related to JABHSU010000643.1
aaaatgcgatagccttggcgttttatagggtgatgtttcgtcatccttggaaattgcagttgggaaaggtatttgtgctgcccgtagcatacggtgcagttaaaacttgccttgcttcgctgcgttatttttaactgcaccgtatgctacgggcagcattggcatagccatagcagggagtcgtctta

SEQ ID NO: 18946 - RNA, 180 nt, unidentified
  source 1..180: mol_type = other RNA; note = Planctomycetaceae bacterium; note = Related to PBCP01000062.1
cgatagccttggcgaattatagggtgatgtttcgtcatccttgtttaacattgcgacgagcggaaattgtgcaacactacggaaagctcaatttcattactacgcttcgcttcgtaatgaaattgagctttccgtagtgttgcattggcgtagccacagcagggaatcgtcggggttggc

SEQ ID NO: 18947 - RNA, 180 nt, unidentified
  source 1..180: mol_type = other RNA; note = Related to NZVD01000016.1; note = Rhodopirellula sp.
ggtcagatagccttggcgaattatagggcgatgcttcgtcgtccttgtaaattgctgcatcgaacgggatttgtgaacatcgtagataatacggcgttcctacgtcctcgcttcgctgcggagtaggaacgccgtattatctacgatgttcattggcatagccatagcaaggaatctgat

SEQ ID NO: 18948 - RNA, 165 nt, unidentified
  source 1..165: mol_type = other RNA; note = Related to PBHI01000033.1; note = Planctomycetaceae bacterium
acgatagccttggcgaataatagggcgatgtttcgtcgtccttgtaatttggttcgcggataagtagttgtgcgtacggttcgatccataaatcaagggtcgctccgctccgcctttatttatggatcgaaccgtacgcattggcattgccatagcaaggaatcg

SEQ ID NO: 18949 - RNA, 175 nt, Proteus sp.
  source 1..175: mol_type = other RNA; note = Related to JAEHOZ010000020.1; note = Proteus mirabilis
aattcaattacggagcggcgaagaattgtcgcgagggtgtgcatcatgcccgtttgcgaaggctaggcacagaaacaccgatggacaaacgtccattcgtgcttcgcccgactggacgtttgtccatcgttgtaaatttaatgaaaagaacagtgtcatgaatgccgcgccgctc

SEQ ID NO: 18950 - RNA, 170 nt, unidentified
  source 1..170: mol_type = other RNA; note = Related to NZ_ML064597.1; note = Parashewanella spongiae
aattcaaatacggagcggcgaaaaattgtcgcgagggtgtgcatcatgcccgtttgcgaaggctagacacagaaacaccgatggacaaacgtccattcgtgcttcgcccgactggacgtttgtccatcgttgtaaatttgatgaaaagtacagtgtcatgaatgccgcgc

SEQ ID NO: 18951 - RNA, 157 nt, unidentified
  source 1..157: mol_type = other RNA; note = Related to SIHM01000015.1; note = Alteromonas sp.
tttacctacggagcggcgaatgattgtcgcgagggtgtggatcatgcccgtttgcgaaggctagacacagaaacaccgatggacaaacgtccatccgtgcttcgcccggctggacgtttgtccatcgttgtaaattttattaaaagtacagtgtcat

SEQ ID NO: 18952 - RNA, 171 nt, unidentified
  source 1..171: mol_type = other RNA; note = Related to VFRR01000008.1; note = Maribrevibacterium harenarium
tgcaaaaacggagcggcgaagaattgtcgcgagggtgtgcatcatgcccgtttgcgaaggctagacacagaaacaccgatggacaaacgtccatccgtgcttcgcccggctggacgtttgtccatcgttgtaaattttttgaaaagtacagtgtcatgaatgccgcgccgc

SEQ ID NO: 18953 - RNA, 158 nt, Vibrio sp.
  source 1..158: mol_type = other RNA; note = Related to NZ_CP025796.1; note = Vibrio owensii
taaaaaacggagcggcgataaattgtcgcgagggtgtgtatcatgcccgtttgcgaaggcttgacacagaaacaccgatggacgaacgtccatccgtgcttcgcccggctggacgttcgtccatcgttgtaaacatcttgaaaagtacagtgtcatga

SEQ ID NO: 18954 - RNA, 167 nt, Vibrio sp.
  source 1..167: mol_type = other RNA; note = Related to RDPS01000003.1; note = Vibrio anguillarum
taaaaaacggagcggcgataaattgtcgcgagggtgtgtatcatgcccgtttgcgaaggcttgacacagaaacaccgatggacgaacgtccatccgtgcttcgcccggctggacgttcgtccatcgttgtaaacatattgaaaagtacagtgtcatgaatgccgcgc

SEQ ID NO: 18955 - RNA, 170 nt, unidentified
  source 1..170: mol_type = other RNA; note = Related to PGZF01000003.1; note = Gammaproteobacteria bacterium HGW-Gammaproteobacteria-15
tatattgcatgggagcggcgatgaattatcgcgagggtgtgaatcatgcccgcttgcgaaggctagacacagaatcaccgatggacaagcgtccatccgtgcattcgcccaaatggacgcttgtccatcgtcgaaacttatttatgagatttgtgtcatgaatgccgcgc

SEQ ID NO: 18956 - RNA, 161 nt, Acinetobacter sp.
  source 1..161: mol_type = other RNA; note = Related to JAEDYI010000001.1; note = Acinetobacter bereziniae
tggctttaggagcggtgaaacagttacgcgagggtgtgtatcatgcccgtttgcgaaggctagacacagaatcactgatggacttgagtccactagtgcttcgcccaattggactcaagtccatcattgaaacattttgaattttgagaattgtgtcatga

SEQ ID NO: 18957 - RNA, 175 nt, unidentified
  source 1..175: mol_type = other RNA; note = Related to JACBJC010000018.1; note = Serratia fonticola
attatgctttaggagcggtggtttattttcgcgagagagtgtatcattctcgttagcgaaggccagacacagaagcatcgatggacatgcgtccattcgtgcttcgcacaactggacgcatgtccatcgttgtcaataaactgattagctaaggtaagtgtcatgaatgccgcac

SEQ ID NO: 18958 - RNA, 163 nt, unidentified
  source 1..163: mol_type = other RNA; note = Related to NZ_WRPA01000017.1; note = Shewanella insulae
tatggattaggagcggcggtgaattatcgcgagggtatgaatcatacccgctggcgaaggctaggcacagaagcatcgatggactcacgtccatcttcgcttcgctcatcaggacgtgagtccatcgttgagaaagaaataatgttaaagagatttgtgtcat

SEQ ID NO: 18959 - RNA, 164 nt, unidentified
  source 1..164: mol_type = other RNA; note = Related to NZ_KB893650.1; note = Kangiella aquimarina
attttttaggagtggtgctaatggtttgcgagggtgtgtatcatgcccgtgagcaaagagctaatatagaagggtgttggatacttatcctgcgctccttcgaagcacatgataagtatccaacacgcacaaagaaactgttttgtattaaggcgtcagtgcta

SEQ ID NO: 18960 - RNA, 181 nt, unidentified
  source 1..181: mol_type = other RNA; note = Proteobacteria bacterium; note = Related to JAFEDC010000007.1
aattgattcgagaagtggcgatttttaatcgtgagggtgtgtatcatgcccgtttgcgaaggctaggcatagaaggcggacggataattatctgccgatccttcgaatcgacagataattatccgtcggcattgaagaaacttaaatagatattgtgtatgccatgatagctccgccactt

SEQ ID NO: 18961 - RNA, 178 nt, unidentified
  source 1..178: mol_type = other RNA; note = Related to JAFIUX010000008.1; note = Nitrospira sp.
aattacagagaggagtggcggtttgtggtcgcgagggtatgtatcatgcccgtttgcgaaggctaggcacagaagggcggcggaagattctcagtcgctccttcgaaccggctgagaatcttccgccggcatcaaagaaactcgaactggatttagtgccatgttagctccgccactc

SEQ ID NO: 18962 - RNA, 165 nt, unidentified
  source 1..165: mol_type = other RNA; note = Related to PGFZ01000010.1; note = Methylovulum psychrotolerans
taaattcgggagaggaggttattactcgcgagggtgtgcatcatgcccgtatgcgatggctaggtacagaagaagcgatgaaataaatccaccgctccttcgaatcgatggatttatttcatcgctttcttaaagaaactattatttttactatgaaagccccgc

SEQ ID NO: 18963 - RNA, 175 nt, unidentified
  source 1..175: mol_type = other RNA; note = Related to VENC01000012.1; note = Marinobacter adhaerens
aatattcgtggggagcggcggctccaactcgtgagggtgtgtatcatgcccgtttgcgaaggctaggcacagaaggtcggtggaacaaagcccatcgctccttcggatcgctggactttgttccaccgatatcaaagaaacgtattgagatagtgtcatgatagccgcgccgctc

SEQ ID NO: 18964 - RNA, 177 nt, unidentified
  source 1..177: mol_type = other RNA; note = Related to CP064972.1; note = Holophagales bacterium
cactagtctgaatggcggcggctttgcgcgcgggcgtgcatcacgcccagccgttgcgcaggtcagccacagaagggcgccggctcctcgccggtcgctccttcggatcgctcgacgaggagccggcgatctcaatgaaagcctccgggctttgctaatcccgtgaagccgccgcca

SEQ ID NO: 18965 - RNA, 178 nt, unidentified
  source 1..178: mol_type = other RNA; note = Acidobacteria bacterium; note = Related to JAGQSE010000087.1
aacttcatcttcgcggcggaggtgttccgcgagggtgtgcatcacaccccttttgcgaaggctagtcatagaagggcgccagctcagaggccggcgctccttcagatcaccggcctctgagctggcggtcccaacgaaagctttgatagctttgctcttcccgtgaacactccgccgc

SEQ ID NO: 18966 - RNA, 167 nt, unidentified
  source 1..167: mol_type = other RNA; note = Related to JADFXO010000295.1; note = Nitrospirae bacterium
gctattttataggaatggcggaatggaatcgtgagggtgtgtatcatgcccaattgcgaaggtcaggcacagaaggacgacggcctaacggctgtcgttccttcgtcgcgccagccgttaggccgtcgtcatcatcgaaagtaagtaaaactttgctgtcgccatga

SEQ ID NO: 18967 - RNA, 176 nt, unidentified
  source 1..176: mol_type = other RNA; note = Proteobacteria bacterium; note = Related to JAHJTB010000218.1
taaaacaaggagaggtggagattcctcgcgcgggtatgtatcatgccctgaagcgaagatcaggcacagaagggcggctgccaatcggctgtcgctccttcgaaccgaacagccgattggcagccggaactcacgtaagtcctatggacttagcttaagccatgaatgctccacct

SEQ ID NO: 18968 - RNA, 186 nt, Pseudomonas fluorescens
  source 1..186: mol_type = other RNA; note = Related to QFOU01000006.1
ggtagtctctattcggtggtgcctgcttgcgagggtttgtatcattcccatttgcaaagaccagacacagaagatcgccgaatcgaaaggccgattttactgcgaaaaatcgccctttcgactcggcgattccaatgaaagcatttttagctttgctagtaaggttgtctaatgcagtcaccacca

SEQ ID NO: 18969 - RNA, 170 nt, Citrobacter sp.
  source 1..170: mol_type = other RNA; note = Related to NZ_LT556085.1; note = Citrobacter amalonaticus
gatatgttcatgttggtagtggcgttcacgagagcatgtatcatgctcatttgtgaaggtcgcggacagaatgggcgcctgcaaatcagcagtcgttccttcgaaacgtctgctgattcgcaggcgtcatcaacgaaagttttcatcagctttgcttaaggattgaccta

SEQ ID NO: 18970 - RNA, 170 nt, unidentified
  source 1..170: mol_type = other RNA; note = Related to AP022438.1; note = Raoultella planticola
ggtaaatttcagttggtagtggcgttcacgagagcatgtatcatgctcatttgtgaaggtcgcggacagaatgggcgcctgcaaatcagcagacgttccttcgaaacgtctgctgattcgcaggcgtcatcaacgaaagttttcatcagctttgcttaaggattgaccta

SEQ ID NO: 18971 - RNA, 170 nt, Salmonella sp.
  source 1..170: mol_type = other RNA; note = Related to AAIGLR010000001.1; note = Salmonella enterica
ggtatattcgcgttggtagtggcgttcacgagagtatgcatcatgctcatttgtgaaggtcgcggacagaatgtgcgcctgcgaatcagcagtcgttccttcgaaacgtctgctgattcgcaggcgtcatcaacgaaagttttcatcagctttgcttaaggattgacctt

SEQ ID NO: 18972 - RNA, 173 nt, unidentified
  source 1..173: mol_type = other RNA; note = Related to NZ_CM001857.1; note = Musicola paradisiaca
gatatttttacttcggtagtggcgttcacgagagtgtgtatcatgctcatttgtgaaggtcgcgtacagaatgtgcgcctgtgaatcagcaggcgttccttcgaaacgcctgctgattcacaggcgtcatcaacgaaagttttcatcagctttgctaaggaatgaccttatga

SEQ ID NO: 18973 - RNA, 173 nt, unidentified
  source 1..173: mol_type = other RNA; note = Related to JABLUT010000044.1; note = Pantoea agglomerans
gttatttttaaatcggtagtggcgttcacgagagtgtgtatcatgctcatttgtgaaggtcgcgtacagaatgtgcgcctgcaaatcagcaggcgttccttcgaaacgcctgctgattcacaggcgtcatcaacgaaagcttccatcagctttgctaaggaaagaccttatga

SEQ ID NO: 18974 - RNA, 170 nt, unidentified
  source 1..170: mol_type = other RNA; note = Related to JAAQVS010000001.1; note = Morganella morganii
gatagtctaagagaggtagtggcgttcacgagagtatggatcatactcatttgtgaaggtcacgcacagaatgggcgcctgcaaatcagtaggcgttccttcgaaacgtctactgattcgcaggcgtcatcaacgaaagttttcatcgactttgcttaaggaatgaccta

SEQ ID NO: 18975 - RNA, 169 nt, unidentified
  source 1..169: mol_type = other RNA; note = Related to NZ_CP082360.1; note = Klebsiella sp.
gttatttttaacgttggtagtggcgttcacgagggtgtgtatcatacccatttgtgaaggtcgcgtacagaatgtgcgcctgtgaagcagcaggcgctccttcgaaacgcctgctgcttcacaggcgtcatcaacgaaagcctcatcagctttgcttaaggactgacct

SEQ ID NO: 18976 - RNA, 170 nt, Enterobacter sp.
  source 1..170: mol_type = other RNA; note = Related to NZ_KN549084.1; note = Enterobacter asburiae
ggtaatttactgtcggtagtggcgttcgcgagagtgtgtatcacactcatttgcgaaggtcgcggaaagaatgggcgcctgagaagcagcaggcgttccttcgaaacgcctgctgcttctcaggcgtcatcaacgaaagttttcatcagctttgctaaaggatggacctt

SEQ ID NO: 18977 - RNA, 183 nt, unidentified
  source 1..183: mol_type = other RNA; note = Related to NZ_CP009801.1; note = Yersinia intermedia
taaagtccttatcggtggtggcggaatcacgagagtatgtatcatgctcatttgtgaagatcatgcacagaagggcgcctgcacacaggcagacgctccttcgaatcgtctgcctgtgtgcaggcggcatcaacgaaagctatcagctttgctaaaggtagatctatgagaacgccaccacca

SEQ ID NO: 18978 - RNA, 178 nt, unidentified
  source 1..178: mol_type = other RNA; note = Related to DOQQ01000002.1; note = Comamonas kerstersii
tagatttgtcctcggtgatagcgcctaggtgtgggcatgtatcatgcccgtttgctaagaccatcgacagaaggatgcctgccgcaaggcgggtgctccttcgaatcacccgccttgcggcaggcttcatttacgaaggcttttttgctttgctttatcgatgaaggcactatcacca

SEQ ID NO: 18979 - RNA, 180 nt, unidentified
  source 1..180: mol_type = other RNA; note = Related to FCLB01000008.1; note = Serratia marcescens
aactatatgcggtggtggtgaagtcgcgagagtgtgtatcacgctcattagcgaagatcatccatagaagggcgcctgtacgcaggcagacgctccttcgaatcgtctgcctgcgtacaggcggcatcaacgaaagcgatcagctttgctaaaggtagatctatgaaaacttcaccacca

SEQ ID NO: 18980 - RNA, 175 nt, Pseudomonas sp.
  source 1..175: mol_type = other RNA; note = Related to FTMP01000014.1; note = Pseudomonas alcaligenes
ggtaggtttcgctcggtggtggcgtcgcgagggcgtgtatcatgcccatcagcgaagaccatgcacagaagggcgcctgcgaaaaggcagcgcctccttcggattcgctgcctttccgcaggcggcaacaacgaaagccaagacagctttgcttgtatgggaacgccaccaccac

SEQ ID NO: 18981 - RNA, 180 nt, unidentified
  source 1..180: mol_type = other RNA; note = Related to DMTT01000123.1; note = Idiomarina loihiensis
tagatttggcttgtagttctgctttccgtgagggtgtgcatcatgccctttagttatagtccagcgcaagaaggtgcgcctgcattcctgcagagcctccttcgaagtccctgcaggaatgcaggcggcatatacgaaagtttacctttgctcgggagttggatttgaaagcagaactac

SEQ ID NO: 18982 - RNA, 178 nt, unidentified
  source 1..178: mol_type = other RNA; note = Related to JAIENL010000062.1; note = Burkholderiaceae bacterium
taaattcagcttcggtggtagtgccagcgcgagggcgtgcatcacgcccattagcgaagactatgtacagaaggaagcctgccgaaaggcgggcgctccttcgaatcacccgcctttcggcaggcttcatcaacgaaggctctttagccttgcttttgcagtgaaggcgctaccacca

SEQ ID NO: 18983 - RNA, 178 nt, unidentified
  source 1..178: mol_type = other RNA; note = Related to NZ_CP017476.1; note = Hydrogenophaga crassostreae
tagatttgtcatcggtggtggcaccatcgcgcgagtgtgtatcacactcatcagcgaagaccatcgacagaaagaagcctgccgaaaggcgggcgctccttcgaatcacccgcctttcggcaggcttcatttacgaaggctactcagccttgctcttccggtgaaggcgccaccacca

SEQ ID NO: 18984 - RNA, 181 nt, unidentified
  source 1..181: mol_type = other RNA; note = Related to JAGNNA010000003.1; note = Reyranella sp.
ggtagcgtttctatggtggtggtgtcatcgcgagggtgtgtatcatgcccattagcgaagactagccttagaaggaacgccggctgagtggccgtcgctccttcgaatcgacgcccactcagccggcgttcacaacgaaagctctaacagctttgctgctcccgtgaaggcaccaccacta

SEQ ID NO: 18985 - RNA, 180 nt, Chromobacterium sp.
  source 1..180: mol_type = other RNA; note = Related to NZ_JYKA01000004.1; note = Chromobacterium subtsugae
gatagaatccttacgtggtggtgtagtcgtgtgggtgtgtatcatgcccatgagtgacgaccgggcacagaagtgcagcctgtctaacggcagctgctccttcgaatcagctgccgttagacaggctacattgacgaaagtatctttttagactttgctaccttgaacacaccaccactc

SEQ ID NO: 18986 - RNA, 175 nt, unidentified
  source 1..175: mol_type = other RNA; note = Related to RQIZ01000001.1; note = Paraburkholderia tropica
gatatactgcgtccggcggtgtgttccgcgtgagtgcgtatcgcgctcgaatgcgaaggccgaggacagaagggagcctgccgaacgacggccgatccttcgaatcgtccgccgttcggcaggcgtcacaacgaaagccatcacagctttgctcttcccgtgaacacaccgcccc

SEQ ID NO: 18987 - RNA, 175 nt, unidentified
  source 1..175: mol_type = other RNA; note = Related to NZ_JJMR01000016.1; note = Burkholderia sp.
gatacaatcggaccggtggcgtgtttcgcgtgagtgcgtatcgcactcgtatgcgaaggccgtatatagaagggggcctgccgaagggcggccgctccttcgaatcgtccgcccttcggcaggcggctcaacgaaagcaatctcagctttgctcttcccgtgaacacgccaccac

SEQ ID NO: 18988 - RNA, 175 nt, unidentified
  source 1..175: mol_type = other RNA; note = Related to JAEDZZ010000001.1; note = Burkholderia oklahomensis
gatatactcgccccggtggcgtgtttcgcgagagtgcgtatcgcgctcatttgcgaagaccatggacagaagggtgcctgccgaacggcggccgctccctcggatcgtccgccgttcggcaggcgactcaacgaaagcaatctcagctttgctcttcccgtgaacacgccaccac

SEQ ID NO: 18989 - RNA, 147 nt, unidentified
  source 1..147: mol_type = other RNA; note = Related to NZ_RBXL01000001.1; note = Thiocapsa rosea
ggaaggtaaaaacttgcgatggggcgcaacgccccagcttgcaaaggtctggtacagaaggttcggtcgggttcgcaccgaagatgcttcgcatcttcggcacgaacccgaccggcgctcaacgaaagcgatctgcgctttgcttta

SEQ ID NO: 18990 - RNA, 147 nt, unidentified
  source 1..147: mol_type = other RNA; note = Related to NZ_CP073100.1; note = Luteolibacter ambystomatis
gcgcatctctctactgcgagagggtgcatcatcctcattagcagaggtctacgacagaagggccggcggccatgcggcgaccgccccttcggttcggatcgccgcatggccgccggatctcaacggaagttctcaacacttcgcttt

SEQ ID NO: 18991 - RNA, 180 nt, unidentified
  source 1..180: mol_type = other RNA; note = Related to NZ_BCNS01000018.1; note = Marinobacterium profundum
tgtggccgggagtggtggaaaaagatcacgcaggtgtgcatcatgcctattagtgaaggcttaccacagaagggccggcagtctattggcctccgccccttcgggacgtcagccaatagactgccgtcatcaacgaaagtcaaccgactttgctataattaagctatgaatattccacca

SEQ ID NO: 18992 - RNA, 175 nt, unidentified
  source 1..175: mol_type = other RNA; note = Related to CABVLY010000035.1; note = Burkholderia anthina
gatagactacgcacggcggtgtgttgcgcgagagtgtgcatcacactcacatgcgaagacccttcgacagaaggacgcctgccgaacggcgggcgatccttcgaatcgcccgccgttcggcaggcggcgtcaacgaaagcaaccagctttgctcttcccgtgaacacaccgccac

SEQ ID NO: 18993 - RNA, 175 nt, unidentified
  source 1..175: mol_type = other RNA; note = Related to NZ_CP034197.1; note = Ralstonia solanacearum
gatagactgccgacagcggtgtgttgcgcgagagtgtgcatcacactcatttgcgaagaccgcacgatagaaggacgcctgacgaacggcggacgatccttcgaatcgcccgccgttcgtcaggcggcggcaacgaaagcaaccagctttgctcttcccgtggacacaccgctac

SEQ ID NO: 18994 - RNA, 172 nt, Azotobacter beijerinckii
  source 1..172: mol_type = other RNA; note = Related to FNYO01000057.1
agtaccctgagtgagtgggagcctcaggcgagggtgtgtatcatgcccatctgccaagatcctgcaaagaagggcaccggtcacatggccggcactccttcggagcaccggccatgtgaccggcgcagtacgaaagcaatttaaggctttgctaagtatgaggctcccacac

SEQ ID NO: 18995 - RNA, 172 nt, Pseudomonas sp.
  source 1..172: mol_type = other RNA; note = Related to PTLV01000220.1; note = Pseudomonas oleovorans
aggatcctattgttgtgggagcctcaggcgcgggtgtgtatcatgcccaattgccaagatccaccatagaagagctccggccagcgagccggcacgccttcggcgcaccagctcgctggccggcgctttacgaaagcaatttaaggctttgctaagtatgaggctcccacaa

SEQ ID NO: 18996 - RNA, 173 nt, Azotobacter beijerinckii
  source 1..173: mol_type = other RNA; note = Related to NZ_FOFJ01000068.1
cgtaatctagtgtcgtgggagcctcaggcgagggtgtgtatcatgcccgttctgccaagacccaccaaagaagggcaccgtggaggcacacggcgctccttcgaagcaccgcgtacctccacggtgcaatgcgaaagcaacttgaggctttgcttagtatgaggctcccaccc

SEQ ID NO: 18997 - RNA, 167 nt, unidentified
  source 1..167: mol_type = other RNA; note = Related to NZ_SPUM01000038.1; note = Massilia horti
tgtaatattcgagcgtgggagcctcgacgagagtgtgtatcacactcatttgtcaagacttatcatagaagggtgccggaaaactctccggcgctccttcgaagcaccgaagatttttccggccccaaaacgaaagttaaaaactttgctaaatgaggctcccactt

SEQ ID NO: 18998 - RNA, 163 nt, unidentified
  source 1..163: mol_type = other RNA; note = Related to NZ_JAGIXE010000037.1; note = Acidocella facilis
gtaacttggtgtccgtggggcctcaggcgagggcgtgcagcacgcccattgcgccaagactaatgacagaaggatgccgtcgtttgggcggtgttccttcgaaacacagcccaaacgacggcatctcgatgaaagtcaactttgctatatgaggctcccacac

SEQ ID NO: 18999 - RNA, 166 nt, unidentified
  source 1..166: mol_type = other RNA; note = Related to WMBU01000038.1; note = Rhizorhabdus histidinilytica
gataaatgtcgcttgtgggagcttcaggcgagagcgtgcatcacgctcactgcgccaagaccgaggttagaagggatgccggcggtctcgccgacgctccttcgaaccgccgacgagaccgccggcactccatgaaagtgaactttgctatatgaggctcccacaa

SEQ ID NO: 19000 - RNA, 164 nt, unidentified
  source 1..164: mol_type = other RNA; note = Related to NZ_JAIZQS010000002.1; note = Burkholderia cepacia
ataaacttcttcgcgcgggagcttcggcgcgggtgtgtatcacacccactcgccaagatcagggacagaaggattccggcgaaatggctggggatccttcgaatccccagccatttcgccggctacactacgaaagctacctttgctaaatgaggctcccgctc

SEQ ID NO: 19001 - RNA, 165 nt, unidentified
  source 1..165: mol_type = other RNA; note = Related to NZ_CADFBE010000001.1; note = Burkholderia gladioli
gataaactgcccctcgcgggagcttcggcgcgggcgtgtatcacgcccactcgccaagatcagggacagaaggattccggcgaaatggctggggatccttcgaatccccagccatttcgccggctacacaacgaaagctaactttgctaaatgaggctcccgccc

SEQ ID NO: 19002 - RNA, 164 nt, unidentified
  source 1..164: mol_type = other RNA; note = Related to NZ_CADFGI010000002.1; note = Paraburkholderia sp.
agtagacttcgcgctgcgggagcttcggcgcgggtatgcatcatacccactcgccaagatcatggacagaaggattccgacgaaatggccggtgatccttcgaatccccgaccatttcgtcggctctaaacgaaagaaaactttgctaaatgaggctcccgcaa

SEQ ID NO: 19003 - RNA, 165 nt, unidentified
  source 1..165: mol_type = other RNA; note = Related to CAJNAS010000001.1; note = Paraburkholderia domus
ggtagacttccacgtgcgggagcttcggcgcgggcgtgcatcacgcccactcgccaagatcagggaaagaaggattccgacgaaatggccggtgatccttcgaatccccagccatttcgccggctctacaacgaaagtaacctttgctaaatgaggctcccgcaa

SEQ ID NO: 19004 - RNA, 166 nt, unidentified
  source 1..166: mol_type = other RNA; note = Proposed Ferrovum sp.; note = Related to JAAGNS010000286.1
gtaatctgatgggcgcgggagcctcggcgcgggtgtgtatcatgcccatttgccaagattacgggatagaagggttccggagaaatggccggagatccttcgaatctccggccatttctccggccgccttgcgaaagcattgctttgctaaatgaggctcccgcaa

SEQ ID NO: 19005 - RNA, 165 nt, unidentified
  source 1..165: mol_type = other RNA; note = Related to JAJTWT010000001.1; note = Pelomonas sp.
ggtaagcttgtcttgcgggagcctcaggcgagggtatgaatcatgcccgcttgccaagaccttgcatagaaggagccggataaacgcccgcgtctccttcgaagccacagtcgtttatccggctgcaatacgaaagctaagctttgctgaatgaggctcccgcac

SEQ ID NO: 19006 - RNA, 166 nt, unidentified
  source 1..166: mol_type = other RNA; note = Related to MWOL01000027.1; note = Rhodococcus sp.
ttaagctgcgttctgcgggagtctcaggcgcgggtgtgcatcatgcccatttgccaagaccacggatagaaggaggcctgagaactggctggggctccttcgaatccccagccagttctcaggccgcattacgaaagctttgctttgctaaatgagactcccgcaa

SEQ ID NO: 19007 - RNA, 172 nt, unidentified
  source 1..172: mol_type = other RNA; note = Desulfurellales bacterium; note = Related to SSEM01000053.1
ctaacctttttgatgcgggagcctcaggcgagggtgtgcatcacactcaggtttgttgccaaggtccgggaaagaagggtcgccgacgaatcggctgcggctccttcgaaaccacagccgattcgtcggcgcttaacgaaagcttttgctttgctatatgaggctcccgcaa

SEQ ID NO: 19008 - RNA, 164 nt, unidentified
  source 1..164: mol_type = other RNA; note = Related to PTEU01000002.1; note = Ideonella sp.
gataatcttgctgtgcgggagtctcggcgcgggtgtgaatcatgcccattcgccaagatcacggatagaagggatccggcgaactggctgcggctccttcgaatccgcagccagttcgccggctccaaaacgaaagttgactttgctaaatgaggctcccgcac

SEQ ID NO: 19009 - RNA, 167 nt, unidentified
  source 1..167: mol_type = other RNA; note = Related to CP034464.1; note = Undibacterium parvum
gatacgatagcaacgtgggggtctcggcgagagtgtgtatcatgctcaatttgccaagattatgctttagaagggtgccgtaaaaagattcggtgctccttcgaagccccgaatatttttacggctcctatatgaaagttagactttgctaaatgaggctcccacaa

SEQ ID NO: 19010 - RNA, 167 nt, unidentified
  source 1..167: mol_type = other RNA; note = Related to MDDY01000002.1; note = Xanthomonas arboricola
ggtagcctatgcctgcgggagcctcaggcgcgggtgtgcatcatgcccatttgcctaggttcagtagttagaaggtgccggcgaatcagccggcgctccttcgaagcgccgtctgcttcgccggcgcttaacgaaagcatttgctttgctatatgaggctcccgccc

SEQ ID NO: 19011 - RNA, 167 nt, unidentified
  source 1..167: mol_type = other RNA; note = Related to NZ_MOYM01000001.1; note = Stenotrophomonas sp.
gatagtctatacaggcgggagcctcaggcgcgggtgtgtatcatgcccaattgcccaggcccggtagttagaagggtgccgtcgaatcagccggcgctccttcgaatcgccgtccgattcgacggcgctcaacgaaagcattgctttgctatatgaggctcccgctc

SEQ ID NO: 19012 - RNA, 164 nt, unidentified
  source 1..164: mol_type = other RNA; note = Related to NZ_VOHK01000004.1; note = Luteimonas marina
actaggatgaccttgcgggagcctcaggcgagggtgtgtatcacgcccatcaagccaaggtcgaggatagaaggtgccggcgaagcggccgacgatccttcgaatcgccggccgcttcgccggcgcacaacgaaaaatcattttgctaaatgaggctcccgcac

SEQ ID NO: 19013 - RNA, 166 nt, unidentified
  source 1..166: mol_type = other RNA; note = Related to NZ_KI535289.1; note = Agrobacterium sp.
ttaaacagtttgtcgtgggagcttcaggcgagggtgtgcatcatgcccaaatgccaagactggtacatagaagaccgccgtgagcttgactcgcggtccttcgaaccgagagtcaagctcacggcacttaacgaaagatagctttgctaaaatgaggctcccacac

SEQ ID NO: 19014 - RNA, 166 nt, unidentified
  source 1..166: mol_type = other RNA; note = Related to QFOR01000002.1; note = Shinella sp.
gttaaacagttgtcgtgggagcttcaggcgagggtgtgcatcatgcccaaatgccaagactggtacatagaagagcgccgtgagcttgactcgcggtccttcgaaccgagagtcaagctcacggcacttaacgaaagatagctttgctaaaatgaggctcccacac

SEQ ID NO: 19015 - RNA, 164 nt, unidentified
  source 1..164: mol_type = other RNA; note = Related to WIFE01000020.1; note = Rhizobium laguerreae
aatagaaggatgttgtgggggcttcaggcgcgggtgtgtatcatgcccactagccaagactgtgataagaaggttgccgtaagcacagctcacgctccttcgaatccctcgccgtgcttacggcactcaacgaaagatagctttgctaaatgaagctcccacgc

SEQ ID NO: 19016 - RNA, 164 nt, unidentified
  source 1..164: mol_type = other RNA; note = Related to NZ_LMNG01000030.1; note = Methylobacterium sp.
ggtaacgtgatggcgcgggagtctcaggcgcgggtgtgtatcatgcccatttgccaaggttaaacacataaggtcgccgtctaaagcggcggccttccttcgaaagtccaccactttagacggcactctacggaagcttgcttcgctaaatgagactcccgcaa

SEQ ID NO: 19017 - RNA, 164 nt, unidentified
  source 1..164: mol_type = other RNA; note = Related to NZ_CP010735.1; note = Phaeobacter inhibens
gtaaggatgaaggtgcggaagcctcaggcgcgggtgtgcatcatgcccatttgccaagactacacacagaagggtcgtcgttcttcggacgaacgctccttcgaagcgcacgtccaaagaacgacgcttatgaaaccaaggtttgctaaatgaggcttccgcaa

SEQ ID NO: 19018 - RNA, 164 nt, unidentified
  source 1..164: mol_type = other RNA; note = Related to NC_003911.12; note = Ruegeria pomeroyi
catagtttgtcgttgtggaagcctcaggcgcgggtgtgcatcatgcccatttgccaagactacatacagaagggtcgtcggtcttcgaactggcgctccttcgaagcgccagttcgaagaccgacgctcatgaaacgattgtttgctaaatgaggcttccgcac

SEQ ID NO: 19019 - RNA, 164 nt, unidentified
  source 1..164: mol_type = other RNA; note = Related to NZ_FNEJ01000006.1; note = Salipiger marinus
gctataatcacatcgcgggagtctcaggcgcgggtgtgtatcatgcccacttgccaaggctatgtacagaagggtcgtcggtcttcggactgacgctccttcgaatcgtcagtccgaagaccgacgctcatgaaacgattgtttgctaaatgagactcccgcac

SEQ ID NO: 19020 - RNA, 181 nt, unidentified
  source 1..181: mol_type = other RNA; note = Related to JAAFAL010000034.1; note = unidentified bacterium
aatagtgtgtctgggcgggtgcgtgaggactcggcgcgagtgtgcatcacactcactagccaagatcaggcacagaagggttcggctaagttccgccgggctccttcgaatcccggcgaaacttagccgacgccacaatgaaagccactaagctttgctaatgaggactacgcacccgcta

SEQ ID NO: 19021 - RNA, 163 nt, unidentified
  source 1..163: mol_type = other RNA; note = Related to JAIUPC010000007.1; note = Proteobacteria bacterium
ggtagctttgatgcgtgggagtctcaggcgcgggtgtgtatcatgcccatttgccaagactatgcatagaagggcaccggccatgtcgccggagctccttcgaatcaccgtcgacatggccggtgcttgcgaaagagacctttgctaaatgaggctcccacac

SEQ ID NO: 19022 - RNA, 163 nt, unidentified
  source 1..163: mol_type = other RNA; note = Related to JADCJU010000004.1; note = Roseomonas sp.
gctagcgttgaaatgtgggagcctcaggcgcgggtgtgcatcatgcccactagccaagactatgaaaagaaggacaccggctctgttgtcggcgctccttcgaatcgccgacaacagagccggcgctcacgaaagcgagctttgctaaatggggctcccacac

SEQ ID NO: 19023 - RNA, 164 nt, unidentified
  source 1..164: mol_type = other RNA; note = Related to NZ_CP041191.1; note = Labrenzia sp.
aataattttgacgtgtgagggcctcaggcgcgggtgtgtatcatgcccactagccaagactatacatagaagggttccgaccatgctgtcggcgctccttcgaaccaccaacaacatggtcggacacttatgaaagccagctttgctaaatgaggctctcacac

SEQ ID NO: 19024 - RNA, 163 nt, unidentified
  source 1..163: mol_type = other RNA; note = Related to NOXU01000023.1; note = Niveispirillum lacus
cgtaatcatggcatgtgggagtctcaggcgcgagtgtgtatcacgctcaactgccaagatctacgacagaagggccccggccatgtcgccgctgctccttcgaaccaccgccgacatggccggtgctcatgaaagcgagctttgctaaatgaggctcccacac

SEQ ID NO: 19025 - RNA, 184 nt, unidentified
  source 1..184: mol_type = other RNA; note = Related to JADLAT010000006.1; note = Alphaproteobacteria bacterium
gtaatctcggctgcgtgggagtctcgggcgcgagcgtgtatcacgctcaaatgctaagaccaaaaacagaaggattccggtggatgtaccggagctccttcgaacctccggtacatccaccggctctctcgaaagtgacctgttatttattaagagggatctttgctaaatgagactcccacac

SEQ ID NO: 19026 - RNA, 178 nt, unidentified
  source 1..178: mol_type = other RNA; note = Rhodospirillaceae bacterium; note = Related to JABJKH010000091.1
ttaacatgaaaagcgtgggagtctcaggcgcgggcgtgcatcacgctcaactgcctagaccaagaacagaagggcccggcttgtcagtcggtgctccttcgaatcaccgccagacaagccggtgctctcgaaaggtactcttaccgaaaggaacctttgctatatgaggctcccacaa

SEQ ID NO: 19027 - RNA, 164 nt, unidentified
  source 1..164: mol_type = other RNA; note = Related to CP045631.1; note = Roseibium aggregatum
cttagttttgtcgtgtgggaacttcgggcgaaggtgtgcatcacacctgcttgccgaggctagacgacagaaggttccgccatcttcgattggcgctccttcagaccgtcaatcgaagatggcggtacttacgaaaggtaactttgctaatgaggttcccacac

SEQ ID NO: 19028 - RNA, 163 nt, unidentified
  source 1..163: mol_type = other RNA; note = Related to NZ_FREX01000003.1; note = Pseudovibrio sp.
actaaggtttactcgtgggagtctcggcgagggtgtgtatcatgcccatttgctaagaccaaatacagaaggattccgccgaattcaccggcagtccttcgaacttccgatgaattcgtcggctccttacgaaaggttactttgcttaatgagactcccacac

SEQ ID NO: 19029 - RNA, 165 nt, unidentified
  source 1..165: mol_type = other RNA; note = Related to NZ_AXZR01000004.1; note = Sulfitobacter pontiacus
agtacatgtaaactgtggaaacctcaggcgcgggtgtgcatcatgcccttatgccaagaccagaacttagaaggacccgccatatctatttggcgctccttcgaaacgccaaatagatatggcggtactcttgaaaggttactttgctaaatgaggtttccacac

SEQ ID NO: 19030 - RNA, 161 nt, unidentified
  source 1..161: mol_type = other RNA; note = Hyphomicrobiales bacterium; note = Related to NVXB01000069.1
tatagacttgtattgtggaggtttcgacgagagtgtgcatcatgctcatttgttatgactaatcacagaagggtccgccatcttcggcgatgatccttcgaatcctcaccgaagattgcggtgcttttgaaagttgactttgctaaatgaaacctccacac

SEQ ID NO: 19031 - RNA, 179 nt, unidentified
  source 1..179: mol_type = other RNA; note = Desulfobacteraceae bacterium Eth-SRB1; note = Related to RPGP01000001.1
gaggaaaaaaaggaatcggttggcgcttcgccaacctcagatggtagcagtactttacaagattttgcgcggccaataaaatcggccgccgcacctcggtaccctcggcacaacggccgattttattggtcgcggatctcaaagcaactgaattttcaagttggtcttaatttttcctc

SEQ ID NO: 19032 - RNA, 180 nt, unidentified
  source 1..180: mol_type = other RNA; note = Related to JACQWO010000092.1; note = Desulfobacterales bacterium
gtacgagaacaggattcggttggcgattcgccatccacggaaggtagcataattttacaagagggtgcgtggccaataaaaccggccgctgctcctcgggttcctcggaccaccggccgattttattggccacggatctcaaagcaactaagtattgaagttggccctagtttttcgtcc

SEQ ID NO: 19033 - RNA, 161 nt, unidentified
  source 1..161: mol_type = other RNA; note = Related to JAHJDK010000078.1; note = Nanoarchaeota archaeon
gagcaaataaaggagttggttggcgattcgccaactgtgataggtagtagggaaatatacaagaggcatcggccaataattgcggccttgccatgcttcggccgaaattattggccgatgctcttaggacagcttttagctgaccctttgaagaacggctc

SEQ ID NO: 19034 - RNA, 178 nt, unidentified
  source 1..178: mol_type = other RNA; note = Betaproteobacteria bacterium; note = Related to JACXUH010000041.1
aagcgcatcaggaattggctggtgattcgccagccgtaaacagtagcggtaatacacaagagggcacgtggccaataagttcggccagtgaccctcgagtacctcgggtccctgtccgaacttattggccacgggtcgtaaggcaacttgatttcaaggttggttctgtaccgcgctc

SEQ ID NO: 19035 - RNA, 187 nt, unidentified
  source 1..187: mol_type = other RNA; note = Related to NZ_KB822693.1; note = Marinobacter sp.
taatggatcaagatttggatggcgcttcgccatcttcagaaattagttcaacattacaagagggctcgcgaccagtaggttctggttcgaagccttcgcggacggagccgactcgtcttcgaaccagaacctactggtcgcgggtctcagagcaacttagtgttcaggttggccttgatttccattc

SEQ ID NO: 19036 - RNA, 188 nt, Nitrosomonas sp.
  source 1..188: mol_type = other RNA; note = Related to SSFV01000001.1
gtagcgaaacaggatttggatggcgattcgccatcttcagaaagtagcacaatttcacaagaaggcacgcggccagtaaattctggctctgcgccttcgcgactaacgtcgacttgtcacagcaccagaatttactggccgcgagtcgttgagcaactgaattctaaagttggccttggttcccaaac

SEQ ID NO: 19037 - RNA, 184 nt, unidentified
  source 1..184: mol_type = other RNA; note = Gammaproteobacteria bacterium; note = Related to PALV01000013.1
atgtggctcaagattcggatggtgattcgccatcttcagaagctagtagtgcattacaagagggctcgcggccagtaaattctggctctgagccttcgcgaacggagtcgactcgtctcagagccagaatttactggccgcgggtctcagagcaacttctctcagttggtcttgatcgtcacac

SEQ ID NO: 19038 - RNA, 161 nt, Desulfovibrio sp.
  source 1..161: mol_type = other RNA; note = Related to ATHV01000015.1
gagcgaggcttggaattgactggcgattcgccagtcgtggagactagatatgttttacaaggtcgacggccaatagcaccggccgccggccccggcgtccggcgctattggccgtcgactttcaagcagctaaaaggttttgctggtccaaagcctcgctc

SEQ ID NO: 19039 - RNA, 161 nt, unidentified
  source 1..161: mol_type = other RNA; note = Related to WYDS01000022.1; note = Halodesulfovibrio sp.
catttagatctggatgcggatggtgcttcgccatccgataaaagaagtttcaagatacaagtgcccagaccaataaaaccgcttggtctcgcgcccgcacaattttattggtctggggcatacaggcagcttacatctacagctggtccaaattccactct

SEQ ID NO: 19040 - RNA, 161 nt, Desulfovibrio sp.
  source 1..161: mol_type = other RNA; note = Related to MLBG01000117.1
gggcggggattggagttgactggtgattcgccagtcatggacttgagttcagacaaacaaagtcgacgaccaataggccaggtcgtcgattccgccgatctggcctattggtcgtcgactttcaagcagctaaagcattcagctggtccactcccccgctc

SEQ ID NO: 19041 - RNA, 164 nt, unidentified
  source 1..164: mol_type = other RNA; note = Related to CP038027.1; note = Brevundimonas naejangsanensis
ggggaggcatcaaggttggtcggcgcttcgccgactttagacactagctcacccataaaaggaagcgtggccaataagtacggccaccacgttcctcctggccgtacttattggccacgcatctcaaggcagtttggcgtatcaactggcttgtccgcctcctc

SEQ ID NO: 19042 - RNA, 164 nt, unidentified
  source 1..164: mol_type = other RNA; note = Related to JAFLCS010000004.1; note = Caulobacterales bacterium
ggaggagcaacaaggttggtcggcgatgcgccgactttagaatctagctcaagcataaaaggatgcgcggccaataacttcggccacagcgttcctcgtgtccgaacttattggccacgcatttcaaggcagttcgatagatcaactggcttgtccgctccttc

SEQ ID NO: 19043 - RNA, 179 nt, unidentified
  source 1..179: mol_type = other RNA; note = Related to NZ_CP031417.1; note = Pseudolabrys taiwanensis
gagctcggtacggaattggctggtgtttcaccagcttcggataccagcactatcgtaaaaggacgcgcggccaataaccttggccgttcgtccttcggacgccgcttcgctaacggccaagcttattggccgcgcattcaagggcagttcattactcgaactggtccaacccggcgctc

SEQ ID NO: 19044 - RNA, 137 nt, unidentified
  source 1..137: mol_type = other RNA; note = Related to NZ_JACSDK010000013.1; note = Pelagibius marinus
gcgaaggggagtcgggcggcgcttcgccgccttcaaacctaaggtctctcatcgattcactcggccgaccccttgggtcgaccgaggacgatggcaaccaaccgcccacgcgggcgtggccggttgctcgccatcgt

SEQ ID NO: 19045 - RNA, 164 nt, unidentified
  source 1..164: mol_type = other RNA; note = Related to SRHQ01000067.1; note = Methylorubrum sp.
gaacagacaacggagtcgggcggcgtttcaccgcccttgttacaaagaacgaccttagaaggtaccggggccaatgagtgcggcccctcggttcctcggggccgcacccattggccccggtactcaaagcagttgactaaaacaactggttcgtcgtcctcctc

SEQ ID NO: 19046 - RNA, 151 nt, unidentified
  source 1..151: mol_type = other RNA; note = Chloroflexi bacterium; note = Related to VXOZ01000123.1
gttcaggcaacggaattgggcggcgcttcgccgtctgaggatgccagttcaacttcacaagggggctcggccaacaagagccggcccctcgttcctcggggtttggcttgttggcctcgcctctctaaggaattgcttattcgcccttcgc

SEQ ID NO: 19047 - RNA, 161 nt, unidentified
  source 1..161: mol_type = other RNA; note = Related to SSDV01000007.1; note = Sphingomonadales bacterium
gtcaaagcaacgggattggacggcgctgcgccgtctgcagatgtaagaccctcaaaaaaaggacccgaggccaataagcttggccccgtcgttcctagtggccaagcttattggcctcggttctctaggcagttatccgaacagactggctctttgccgac

SEQ ID NO: 19048 - RNA, 177 nt, unidentified
  source 1..177: mol_type = other RNA; note = Related to NZ_LAVN01000001.1; note = Burkholderia gladioli
ccccatacgcagaagtcggtcgatgtttcgtcgaccagtcgtactagcggtggtgaagacatacaagaggttccgcggccaacgaaaagttttggtcgcggcgagcgcgcccaagaacgttttccttggccgcggatctttgagcagataagtgatggatctggttctgctacggga

SEQ ID NO: 19049 - RNA, 179 nt, unidentified
  source 1..179: mol_type = other RNA; note = Related to QVIO01000003.1; note = Duganella sp.
gcgccagtcatgcagaagtcggtcgatgtttcgtcgaccatgcaaaacagtggtgagtacgtacaagaagttccgcggccaacgaaaagttgtaaccgcggcgagcgcggtcacgaacgttttcgttggccgcggatctacgagcagatgactaaaggatctggttctgctaacggtgc

SEQ ID NO: 19050 - RNA, 151 nt, unidentified
  source 1..151: mol_type = other RNA; note = Related to VMKF01000002.1; note = Geobacter sp.
gatcggcaacagatgggtggcgcttcgccatctggaagtgaaaaaattttgttaaaagaggttgcgcggccaattcgtacgaccgcgttgccacacggccgtacgaattggccgcgcatcggtaagcaattcctgcatagaaacgttgagc

SEQ ID NO: 19051 - RNA, 175 nt, unidentified
  source 1..175: mol_type = other RNA; note = Related to FNKY01000001.1; note = Nitrosospira multiformis
aattgggaaaagaagaattgactgatgcttcgtcagtctctttaattgaccttgttatacaagaagaggagcggccaataaacccggccgtaactcttggtaaagctcagagtgacggccgggtttattggccgcttctcgctaagcaactttttgttggctctattcctcaatc

SEQ ID NO: 19052 - RNA, 172 nt, unidentified
  source 1..172: mol_type = other RNA; note = Related to NZ_JAAOLY010000027.1; note = Janthinobacterium lividum
aagcgaaatcagagttggctgatgtttcgtcagctagtttaaatgacctcgtttcacaagaagagcagcggccaataagcgcgctcactcctcttcgctccactcatcgtcgcgagcccgcttattggccgcttctcggaaagcaacttctcgttggctctacagttcgctc

SEQ ID NO: 19053 - RNA, 168 nt, unidentified
  source 1..168: mol_type = other RNA; note = Proposed Superficieibacter electus; note = Related to PQGD01000012.1
actgatacagagaatatgggcggtgattcgccgtctttacagttaaggcacaatttaaaagaggttccgcacccaagcctgtcttgggctgcagggaccctgcccagcagcccaagacaggcttgggtgcggatctacgagcaattaaatattggttcgatgtccagt

SEQ ID NO: 19054 - RNA, 168 nt, unidentified
  source 1..168: mol_type = other RNA; note = Related to DACSPQ010000008.1; note = Serratia marcescens
actgatacagagaatatggacggtgattcgccgtctttacagttaaggcacaattcaaaagaggttccgcacccaagcctgccttgggctgcaggggccctacccagcagcccaaggcaggcttgggtgcggatctacgagcaattaaaaattggttcgatgtccagt

SEQ ID NO: 19055 - RNA, 168 nt, unidentified
  source 1..168: mol_type = other RNA; note = Related to LS483483.1; note = Klebsiella oxytoca
actgagtcaaagaaaatgggcggtgcttcgccgtcttcacagttaaggtttgttttaaaagatgctccgcacccaagtgttccttgggcgctcggggccctacccaatcacccaaggaacacttgggtgcggatcgctgagcaaattaattttggttcgatgcttagt

SEQ ID NO: 19056 - RNA, 144 nt, Escherichia coli
  source 1..144: mol_type = other RNA; note = Related to MOFU01000029.1
actgagtcaaagaaaatgggcggtgcttcgccgtctttacagttaaggtttgttttaaaagaggttccgcacccaagtgttccttgnncaaggaacacttgggtgcggatcgctgagcaaattaattttggttcgatgcttggt

SEQ ID NO: 19057 - RNA, 168 nt, unidentified
  source 1..168: mol_type = other RNA; note = Related to AP021929.1; note = Klebsiella pneumoniae
actgaaacagagaaaatgagcggcgattcgccgttcttaacgttaaggcacattttaaaagaggttccgcacccaagcctgccttgggcgaccgggaccctgcccagccgcccaaggcaggcttgggtgcggatctatgagcaattaaagattggttcgacgttcggt

SEQ ID NO: 19058 - RNA, 172 nt, unidentified
  source 1..172: mol_type = other RNA; note = Related to NZ_JADTXJ010000009.1; note = Serratia ureilytica
ctactgaaacaaagaatatgggcggcgaaccgccgtctttacagttaaggccttacataaaagaggttccgcacccaagcctgtcttgggcgtctgggaccttgcccagtcgcccaagacaggcttgggtgcggatctttgagcaattacgaattggttcaatgtccagtag

SEQ ID NO: 19059 - RNA, 171 nt, Enterobacter sp.
  source 1..171: mol_type = other RNA; note = Related to NZ_CP045769.1; note = Enterobacter cancerogenus
actgatacaaagaatatgggcggcgaatcgccgtctttgcagttaaggccatacataaaagaggttccgcacccaagcctgtcttgggcgtccgggaccttgcccagtcgcccaagacaggcttgggtgcggatctttgagcaattacgaattggttcaatgtccagtagt

SEQ ID NO: 19060 - RNA, 171 nt, Enterobacter sp.
  source 1..171: mol_type = other RNA; note = Related to NZ_CP087390.1
actgatacaaagaatatggacggcgcaccgccgtctttgcagttaaggccttacataaaagaggttccgcacccaagcctgtcttgggcgtccgggaccttgcccagccgcccaagacaggcttgggtgcggatctttgagcaattacgaattggttcaatgtccagtagt

SEQ ID NO: 19061 - RNA, 171 nt, Escherichia coli
  source 1..171: mol_type = other RNA; note = Related to NZ_NRWV01000070.1
actgatacaaagaatacgggcggtgaatcgccgtctttacagttaaggccttacataaaagaggttccgcacccaagcctgccttgggcgtccgggaccttgcccagccgcccaaggcaggcttgggtgcggatctttgagcaattacgaattggttcaatgtccagtagt

SEQ ID NO: 19062 - RNA, 171 nt, unidentified
  source 1..171: mol_type = other RNA; note = Related to JACVBT010000006.1; note = Pantoea sp.
actgatacaaagaatatgggcggcgattcgccgtctttacagttaaggcatgatttaaaagaggttccgcacccaggcctgtcttgggcgtccgggaccttgcccagccgcccaagacaggcctgggtgcggatctttgagcaattacaaattggttcaatgtccagtagt

SEQ ID NO: 19063 - RNA, 170 nt, Aeromonas sp.
  source 1..170: mol_type = other RNA; note = Related to NZ_CP038513.1
tcccctgaacagaataaggctagcgtttcgtcagccactatgtttaggtctactgtaaaagtagctccgtggccagaaaactctctggtctcggggcccctcccccaaaaccagagagttttctggccacgggtctcagagcaattaagaattggttctaatgcaggggg

SEQ ID NO: 19064 - RNA, 170 nt, Aeromonas sp.
  source 1..170: mol_type = other RNA; note = Related to NZ_CP033604.1; note = Aeromonas veronii
tcccctgaacagaatatggttagcgcttcgtcaaccattacgtttaggtctacgttaaaagtagctccgtggccagaaaactctctggtctcggggcccctcccccaaaaccagagagttttctggccacgggtctcagagcaattaaaaattggttctaactcggggga

SEQ ID NO: 19065 - RNA, 170 nt, Vibrio sp.
  source 1..170: mol_type = other RNA; note = Related to NZ_AP019654.1; note = Vibrio panuliri
tctcctgaacaggatgtggctggtgtatcaccacccaaagtgtttaggtcaagtttaaaagcagctccgtggccagaaaactctctgtccccaggggccctcccccaaacccagagagttttctggccacgggtctcagagcaattacagattggttctatctcagggga

SEQ ID NO: 19066 - RNA, 170 nt, unidentified
  source 1..170: mol_type = other RNA; note = Related to PIZK01000029.1; note = Alteromonadales bacterium alter-6D02
gcttctgaaagaaattcgggtggtgcatcaccacttaaacaagcaagctcaagcacaaaagtatcccctaggccagaaatttctctgtccccggggccccaaccccaaatccagagaaatttatggcctagggtatatttgcaattaaatattggttcaaaaccagaagc

SEQ ID NO: 19067 - RNA, 170 nt, unidentified
  source 1..170: mol_type = other RNA; note = Related to MBSN01000054.1; note = Alteromonas macleodii
gcttctgaaagaaatacgggtggtgcatcaccacttaagcaagcaagatcaagcacaaaagtatcccctaggccagaaattcctctgccctcggggccccttccccaaaaccagaggaatttctggcctagggtatattggcaattaaatattggttcaaaaccagaagc

SEQ ID NO: 19068 - RNA, 170 nt, unidentified
  source 1..170: mol_type = other RNA; note = Related to NZ_LSNE01000017.1; note = Paraglaciecola hydrolytica
gcttctgaaagaaatatgggtggtgtatcaccacctggaagattaaggtccagcacaaaagtatcccctaggccagaagttcctctgtccctggggccccttccccaaaaccagaggaacttctggcctagggtatatcagcaattaggtattggttcaaaaacggaagc

SEQ ID NO: 19069 - RNA, 170 nt, Vibrio parahaemolyticus
  source 1..170: mol_type = other RNA; note = Related to NZ_MISS01000101.1
tctcctgaacagaaaatggatggtgtaccaccatcttctatgtttaggttatctttaaaagatgctccgaggccagaagaatctctgtcctcggggcccctaccccaaagccagagattcttctggcctcgggtctcagagcaattacaaattggttctaattcagggga

SEQ ID NO: 19070 - RNA, 170 nt, Vibrio sp.
  source 1..170: mol_type = other RNA; note = Related to VIVA01000006.1; note = Vibrio crassostreae
ttccctgtgcaagaaatggttggtgtatcaccatccgaaacgcaaaggttatctttaaaagcagctccgaggccagaagaatctctgtccccggggcccctaccccaaaaccagagattcttctggcctcgggtctcagagcaattaaaaattggttctacttcaggaaa

SEQ ID NO: 19071 - RNA, 170 nt, Vibrio parahaemolyticus
  source 1..170: mol_type = other RNA; note = Related to JACBTA010000009.1
cttttcgaacagaatttggatggtgattcgccatctcctatgttcaggtcaacatcaaaagtagctccgaggccagaagaatctctgtccccggggcccctaccccaaaaccagagattcttctggcctcgggtctcagagcaattgaaaattggttctttctcggaagg

SEQ ID NO: 19072 - RNA, 170 nt, Aeromonas sp.
  source 1..170: mol_type = other RNA; note = Related to CP038441.1; note = Aeromonas media
tcgccgacagggaatctggctggtgcagcaccagttgttaggaacagttcggctttaaaagcagctccgcggccagaagtttctctagcctcggggccccttccccaaaaccagagaaacttctggccgcgggtctctgagcaatttaatattggtcttattgtcggtga

SEQ ID NO: 19073 - RNA, 152 nt, unidentified
  source 1..152: mol_type = other RNA; note = Related to JAJSLX010000004.1; note = Marinibactrum sp.
gtgctagatcagaatttggatgatgcttcgtcatcctctagtataggacttaaatatcaagatgcacagcggtcaaatagctttttggccgctgaccaaaaagctatttggccgctggtctcagagcaatttcagattggttctactagcgc

SEQ ID NO: 19074 - RNA, 170 nt, unidentified
  source 1..170: mol_type = other RNA; note = Burkholderiales bacterium; note = Related to QBMB01000082.1
gctgaggaaccagagaaggctgatgattcgtcagccgtagcaattgattcagcaacacaaggggagcggccaaaaggcgcggccgccaatcctcgcgcagctccgggtgtcggccgcgccttttggccgctcctctctaagcaactttttgttggctcttcccctcaagc

SEQ ID NO: 19075 - RNA, 170 nt, unidentified
  source 1..170: mol_type = other RNA; note = Related to NZ_SCML01000017.1; note = Hydrogenophaga sp.
gctgaggaaccagagaaggctgatgtttcgtcagccgtatttattgactcagcgacacaagaggagcggccaaaaggcgcggccgccaatcctcgcgtagctccgggtgccggccgcgccttttggccgctcctagctaagcaactttttgttggctcttccccttcagc

SEQ ID NO: 19076 - RNA, 167 nt, unidentified
  source 1..167: mol_type = other RNA; note = Related to JAFLDL010000015.1; note = Candidatus Accumulibacter sp.
gtttggggtatcgagcaggctgatgattcgtcggccgtatcccatggaatggcagtgcaagaggacgagcggccaataggcgcggccgtctctcctcgtaggagagacggccgcgcctattggccgctcctctcaaagcagcttttagttggctcttcttccccctc

SEQ ID NO: 19077 - RNA, 173 nt, unidentified
  source 1..173: mol_type = other RNA; note = Related to PBZA01000066.1; note = Sutterellaceae bacterium
gttcaggaaacagagaaggctgatgcatcgtcagccgtagtgattgaaccagtattacaagaggataagcggccaatatccccggccgtccctcctcgcccagctcggagttccggccgtggatattggccgctcctctcaaagcaactttttgttggctcttctaccctgac

SEQ ID NO: 19078 - RNA, 173 nt, Pseudomonas sp.
  source 1..173: mol_type = other RNA; note = Related to NZ_AJXE01000028.1; note = Pseudomonas stutzeri
gccggtgaaccagagaaggctgatgtttcgtcagccgtaattgttgaccaaccagtacaagaggatgagcggccaacaggcgcggcccgccctcctcgcgtagctcgtcgtgcggcccgcgcctgttggccgctcctcgcaaagcaactttttgttggctcttcctcccgcgc

SEQ ID NO: 19079 - RNA, 173 nt, Pseudomonas sp.
  source 1..173: mol_type = other RNA; note = Related to JAAQXA010000034.1
gccggtgaaccagagaaggctgatgtttcgtcagccgtaattgttgacccaccactacaagaggatgagcggccaacaggcgcggcccgccctcctcgcgtagctcgtcgagcgggccgcgcctgttggccgcccctcggtaagcaactttttgttggctcttcctcccgcgc

SEQ ID NO: 19080 - RNA, 173 nt, Pseudomonas sp.
  source 1..173: mol_type = other RNA; note = Related to NZ_WTFT01000007.1; note = Pseudomonas izuensis
gccggtgaatcagagaaggctgatgtttcgtcagccgtaattgttgaccaaccactacaagaggatgagcggccaacaggcgcggtctgccctcctcgcgtagctcgtcgagcagaccgcgcctgttggccgcttctcgcaaagcaactttttgttggctcttcctcccgcgc

SEQ ID NO: 19081 - RNA, 165 nt, unidentified
  source 1..165: mol_type = other RNA; note = Related to DNJA01000297.1; note = Deltaproteobacteria bacterium
agattagtggttagtaacgactctaataggttggcgcttcgccatcctttcgtgcattcttgaaaagaaaggtgcgcgggaaagccggtcggctcccgcgcgccgccgggtccgcccggctttcccgcgcagcatctacgtaaggaaacgaattccttagccatg

SEQ ID NO: 19082 - RNA, 195 nt, unidentified
  source 1..195: mol_type = other RNA; note = Related to NC_016631.1; note = Granulicella mallensis
agacaggtggcgtggttgtttcactttggttgatgtttcgtcaaccgatgtagcaatcaggtaattcatacaagggttgtcaacacgacgacttgcaaaagacaaaaccgcaactcgtcgtgttgacaacacagtcgagcagtgtcaacacactggaatccgaagtgatcacgccgcttgtctctttcacatctt

SEQ ID NO: 19083 - RNA, 187 nt, unidentified
  source 1..187: mol_type = other RNA; note = Related to CP011392.1; note = Dehalogenimonas sp.
agcaaggggagcacgaattatgattgggcgtcgtttcgtcgcccatgtgacaaggctctccataaaatatctcctatttcgagaaataggagatttgcgactcgtcctccgtttgttactacggagcgagcggcaattcacaaggattggacaacatgaatagtctccccttgctggtctccttaga

SEQ ID NO: 19084 - RNA, 153 nt, unidentified
  source 1..153: mol_type = other RNA; note = Chloroflexi bacterium; note = Related to JACPQM010000002.1
ggcaggggagactagtggcctgggcgatgcttcgtcgcccgtggtgcaagactccccgtagaagatcctgcgagctacccgctcgcagtctctccaagcaatcaaagtgagattggaataacggaccatgaaccccctgcccctccttgtgtc

SEQ ID NO: 19085 - RNA, 209 nt, unidentified
  source 1..209: mol_type = other RNA; note = Related to QFWV02000004.1; note = Oceaniradius stylonematis
tgcgagttggtatcgcgttcagcttgttcgttgtttcggcgagccgttgttcaggtttggtttgaaggggctcgtggcctaggtcgaagaggncgttttgccggaccttgccgccaaaacgcctcttcgacctaggccacgcgctcaaggcagtcttcacttcaaagactggaagttgctgtagatgccaactcgctcctactacttcc

SEQ ID NO: 19086 - RNA, 208 nt, unidentified
  source 1..208: mol_type = other RNA; note = Related to JAGRMS010000295.1; note = Pseudooceanicola sp.
agcgagttggtatcgcgttcagcttgctcgctgcttcggcgagccgttgttcaggttcggtttgaagaggctcgcggcctgagtccaagaggcattttgcccaaggtctcggccaaaatgcctcttggactcaggccgcgcgctcaaggcagtcttcacttcagagactggaagttgctgtagatgccaactcgctcatattacttcc

SEQ ID NO: 19087 - RNA, 208 nt, unidentified
  source 1..208: mol_type = other RNA; note = Rhodobacteraceae bacterium R_SAG4; note = Related to JAAZTG010000053.1
tgcgagttggtatcgcgttcagcttgttcgctgtttcggcgagccgttgttcaggtttggtttgaaggggctcgtggcctaggtcgaagaggcattttgccggaccttgccgccaaaatgcctcttcgacctaggccacgcgctcaaggcagtcttcgtttcaaagactggaagttgctgtagatgccaactcgctcatactacttcc

SEQ ID NO: 19088 - RNA, 208 nt, unidentified
  source 1..208: mol_type = other RNA; note = Related to NZ_QDFI01000072.1; note = Phycocomes zhengii
tgcgagttggtatcgcgttcagcttgttcgctgcttcggcgagccgttgttcaggtttggtttgaaggggctcgcggcctaagtccaagaggcattttgcccaaggtctcggccaaaatgcctcttggacttaggccgcgcgctcaaggcagtcttcgcttcagagactggaagttgctgtagatgccaactcgctcatactacttcc

SEQ ID NO: 19089 - RNA, 208 nt, unidentified
  source 1..208: mol_type = other RNA; note = Related to NZ_JAEG01000002.1; note = Ciceribacter selenitireducens
agcgagttggtatcgcgttcagcttgttcgctgtttcggcgagccggtgttcaggttcggtttgaagttgctcacggcctagatcgaagaggcattttgcctcaggtcttcgccaaaattcctcttcgacctaggccgcgcgctcaaagcagtcttacattcagagactggaagttgctgtagatgccaactcgctcatattactttc

SEQ ID NO: 19090 - RNA, 208 nt, unidentified
  source 1..208: mol_type = other RNA; note = Related to JACFOS010000001.1; note = Bartonella sp.
cgcgagttggcatcatgttcagtttgttcgctgtttcggcgagctgacaatcaggttaggcttgaaagggctcgcggaataggctcgagaggcattatgccgggccttgccgccaaaattcctctcaagcctattccgcgtgctcatggcagtctcatttatcaaggctggaagttactgtagatgccaactcgttcctattattttc

SEQ ID NO: 19091 - RNA, 209 nt, unidentified
  source 1..209: mol_type = other RNA; note = Related to PCOI01000001.1; note = Ochrobactrum sp.
cgcgagttggcatcgcacccagcttgttcgctgtttcggcgagcagttcgtcaggttaggtttatagaggctagcggctttggttcgagaggcattttgccggatccgaccgccaaaatccctctcgaaccaaagccgcccgctctaggcagtcttaatattagagactggatcatgctgtaagatgccaactcgctcctactttttcc

SEQ ID NO: 19092 - RNA, 208 nt, unidentified
  source 1..208: mol_type = other RNA; note = Related to NZ_AYPY01000034.1; note = Rhodobacter capsulatus
ggcgagttggcgttgcgttcagcttgttcgctgtttcggcgagcagtttttcaggtttggtttgaaggtgctcgcggcctaggttcgagaggcattttgccggaccttgccgccaaaatgcctctcgaacctaggccgcgcgctcaaggcagtcctcactcttcggactggaagttgctgtaaatgccaactcgctcctattacttcc

SEQ ID NO: 19093 - RNA, 208 nt, unidentified
  source 1..208: mol_type = other RNA; note = Related to NZ_LPZR01000055.1; note = Tistrella mobilis
cgcgagttggtgtcacgtacagcttgttcgctgtttcggcgagctgttgttcaggttcagtatgaagaagctcgtggcctaggttgaagaggcaccttgccggacctagccgccaatgcgcctcttcaacctagtccacgcgctcaaggcagtcttatctttagagactggaagttgctgtagatgccaactcgctcatattattttc

SEQ ID NO: 19094 - RNA, 208 nt, unidentified
  source 1..208: mol_type = other RNA; note = Related to JAAMCC010000006.1; note = Agrobacterium tumefaciens
ggcgagttggtatcgctttcagcttgttcgctgtttcggcgagccggtgatcaggtttggtttgaagaggctcgtggtctaagtccgagaggcaatttgccgaaggctttcgccaaatcgcctctcggacttagaccacgtgctcaaggcagtctcgaatatatagactggaaattgctgtagatgccaactcgctcctactatttcc

SEQ ID NO: 19095 - RNA, 203 nt, unidentified
  source 1..203: mol_type = other RNA; note = Related to NZ_CP045420.1; note = Maribius sp.
tgcgggttggcatttaattcggcttgttcgctgtttcggcgagcggaacttcaggttagggttgtaaggtcacgcggatcgggaagaaggctctgtttgccggaccccgccgccaaacagagccttcttcccgatccgcgtgcattaggcagtcataaagactggaactgctgaactcatgccaacccgctcctactatttcc

SEQ ID NO: 19096 - RNA, 200 nt, unidentified
  source 1..200: mol_type = other RNA; note = Related to QKMF01000007.1; note = Pelagimonas varians
ggcgggttggctgcaaaatcagattgttcgccgttgcggcgagcaggtaaacaggtcaactatataagggctcgtggattgaaaggaagctccggatttccggatctttccggagatccggagcttcctttcaatccacatgctcaaggcagtcttctggactggaatttctgagatgccaacccgctcctattttttcc

SEQ ID NO: 19097 - RNA, 194 nt, unidentified
  source 1..194: mol_type = other RNA; note = Related to VHLH01000001.1; note = Pararhizobium sp.
cgcgggatggcagaattttcgcataggttgctgtttcggcatcctggttttgtggtttggtttataagggctcgcgtttgggggaactcggcaaatttgccgacgagcgccaaattcgccgagttcccccaaacgcgcgcttaagcagtcgtattgactggtatttgcgatgccatcccgcagcttttttctac

SEQ ID NO: 19098 - RNA, 202 nt, unidentified
  source 1..202: mol_type = other RNA; note = Related to VZUL01000002.1; note = Neorhizobium galegae
cgcgaggcggtatcggataggaggctgtaccagctgtcctgccatacaggtcaaataatgtaatcgagcgtgtggttagtaaggatcggtcgccaatcggctgaattctcacccaatcaccgaccgatccttactaaccacacattcaaagcaatcttttgaagattggtttttccaatgccgcctcgctcctactacaatg

SEQ ID NO: 19099 - RNA, 200 nt, unidentified
  source 1..200: mol_type = other RNA; note = Related to JACHXX010000002.1; note = Rhizobium laguerreae
cgcgaggtggttttggataggaggctgcaccagccgtcctgccattcaggtcaaatagtataagtgggcgcgtgattagtaagggccggtcggcaatcgcctgaagcctcagccaatcaccgaccggcccttactaatcacgcattcaaagcaatcccttgagattggtttttccatgccacctcgcagctactacaacg

SEQ ID NO: 19100 - RNA, 201 nt, unidentified
  source 1..201: mol_type = other RNA; note = Related to CP061772.1; note = Ochrobactrum sp.
cgcgaggcggcaacggataggaggctgtaccagctgtcctgccatacaggtaaaatatagtaagacccgcgtgattagtaaggctcggtcggcaatcggctgaactttcacccaatcaccgaccgatccttactaatcacgcattcaaagcaatctttctagagattggtgcttccatgccgcctcgctcctattacaatt

SEQ ID NO: 19101 - RNA, 202 nt, unidentified
  source 1..202: mol_type = other RNA; note = Related to JABBGK010000003.1; note = Rhizobium sp.
cgcgaggcggtatcggatagggggctgcaccagccttcctgccattcaggtcaaatagtataaggatcgcgtgagaagtaaggatcggtcagcgattggctgagccttcacccaaccactgaccgatccttacttctcacgcattcaaagcaatcttcttggagattggtttttcccatgccgcctcgctcctactacaaag

SEQ ID NO: 19102 - RNA, 203 nt, unidentified
  source 1..203: mol_type = other RNA; note = Related to WBWH01000007.1; note = Brucella intermedia
cgcgaggcggtatcggatagggggctgcaccagccttcctgcctatcaggttaaatattgtaaggatcgcgtgagaagtaaggatcagtcagtgattggctgaaccttcacccaatcactgactgatccttacttctcacgcattcaaagcaatctttttggagattggttttttcctatgccgcctcgctcctattatgtag

SEQ ID NO: 19103 - RNA, 200 nt, unidentified
  source 1..200: mol_type = other RNA; note = Related to VFUS01000001.1; note = Mesorhizobium sp.
cgcggggcggcactagataggacactgaatcagtgtcctggctttcaggtcttgcgtgtaaaaaggcgtgctttgtaagagccgctcgagaatggctgcattgcagccacgagcggagttctcgagcgcctcttacaaagcacgcactaagcaatctcaggattggtgttgtcgaatgccgccccgttcttactataatt

SEQ ID NO: 19104 - RNA, 200 nt, unidentified
  source 1..200: mol_type = other RNA; note = Related to JAIUGX010000003.1; note = Mesorhizobium sp.
tgcggggcggcatggataggacgctgcatcagcgtcctggttttcaggtcttgcgtgtaaaaggcgcgctttgtaagagccgctcgagaatggctgcatagcagccacgagcggagttctcgagcgcctcttacaaagcacgcactaagcaatctctaggattggtttttgtctaatgccgccccgctcctactacaatt

SEQ ID NO: 19105 - RNA, 191 nt, unidentified
  source 1..191: mol_type = other RNA; note = Related to NZ_CP049037.1; note = Pseudohalocynthiibacter aestuariivivens
ggcgaggtggcttggatagggcactgcatcagcgtacctgcccttcaggtcacgctcataagggggtgtggctcatcggagccgctcttgctctgggtaagctttacccaaatcaagatcgcctccgatgagccacacttttaagcaatctaggattggctaaaccatgccacctcgctcctactacattg

SEQ ID NO: 19106 - RNA, 195 nt, unidentified
  source 1..195: mol_type = other RNA; note = Related to DQCL01000311.1; note = Octadecabacter sp.
tgcggggtggcttggatagagcgctgcaacagcggctctgcctttcaggtctcccatgtaaggacgtgtgatttgcaagagccggatgcgctttggctggctcccacccaaatcgcatccgtctcttgcaaatcacactttgaagcaatcggtacgagattggccaaaccatgccgccccgctcctactatcttg

SEQ ID NO: 19107 - RNA, 188 nt, unidentified
  source 1..188: mol_type = other RNA; note = Related to NZ_CP080493.1; note = Pseudochrobactrum sp.
gacgaggcggtaatttggaggctgtagcagtcttccgggtgtttaggctcaattttgtaagagatcgtgattagtaagagaagaagggcatcgcctgactctcagacaatccccttcttctcttactaatcacgctcttaaagcaatctatgattggtgaaatatgccgcctcgttcttattatcatt

SEQ ID NO: 19108 - RNA, 189 nt, unidentified
  source 1..189: mol_type = other RNA; note = Related to NZ_QDKO01000009.1; note = Caulobacter sp.
gtcggggcggcactcacgattggccgctgaagcagcagccataggttttcttggttgggcgtaaagggctcgcggttaggcttctgtcgcgctttcgggcgcagccaaaaccgcgacagaagcctaaccgcgtgctcttaagcaactaatttggttggtaaaacgtgtcgccccgcacctacgacctca

SEQ ID NO: 19109 - protein, 238 aa, synthetic construct
  VARIANT 5: note = X can be any amino acid
  VARIANT 10..11: note = X can be any amino acid
  VARIANT 13: note = X can be any amino acid
  VARIANT 15: note = X can be any amino acid
  VARIANT 18: note = X can be any amino acid
  VARIANT 20..22: note = X can be any amino acid
  VARIANT 25..26: note = X can be any amino acid
  VARIANT 28..40: note = X can be any amino acid
  VARIANT 42..45: note = X can be any amino acid
  VARIANT 48..52: note = X can be any amino acid
  VARIANT 55: note = X can be any amino acid
  VARIANT 58..59: note = X can be any amino acid
  VARIANT 61..64: note = X can be any amino acid
  VARIANT 66: note = X can be any amino acid
  VARIANT 69: note = X can be any amino acid
  VARIANT 71..73: note = X can be any amino acid
  VARIANT 79..106: note = X can be any amino acid
  VARIANT 109..117: note = X can be any amino acid
  VARIANT 119: note = X can be any amino acid
  VARIANT 129..130: note = X can be any amino acid
  VARIANT 133..134: note = X can be any amino acid
  VARIANT 136..137: note = X can be any amino acid
  VARIANT 140..145: note = X can be any amino acid
  VARIANT 147..152: note = X can be any amino acid
  VARIANT 154: note = X can be any amino acid
  VARIANT 160: note = X can be any amino acid
  VARIANT 165..169: note = X can be any amino acid
  VARIANT 171..173: note = X can be any amino acid
  VARIANT 175..180: note = X can be any amino acid
  VARIANT 182..191: note = X can be any amino acid
  VARIANT 193..194: note = X can be any amino acid
  VARIANT 197: note = X can be any amino acid
  VARIANT 207: note = X can be any amino acid
  VARIANT 210: note = X can be any amino acid
  VARIANT 212..213: note = X can be any amino acid
  VARIANT 215..218: note = X can be any amino acid
  VARIANT 220: note = X can be any amino acid
  VARIANT 223..224: note = X can be any amino acid
  VARIANT 227: note = X can be any amino acid
  VARIANT 229..230: note = X can be any amino acid
  VARIANT 232..238: note = X can be any amino acid
YKVYXIPKRXXGXRXIAXPXXXLKXXQXXXXXXXXXXXXXHXXXXAYXXXXXIKXNAXXHXXXXYXLKXDXXXFFNSIXXXXXXXXXXXXXXXXXXXXXXXXXXXXFWXXXXXXXXXLXLSXGAPSSPXXSNXXMXXFDXXXXXXCXXXXXXYXRYADDXTFSTXXXXXLXXXPXXXXXXLXXXXXXXXXXNXXKTXFSSKAHNRHXTGXTXXNXXXXSXGRXXKRXIXXLXXXXXXX

SEQ ID NO: 19110 - protein, 237 aa, synthetic construct
  VARIANT 3..5: note = X can be any amino acid
  VARIANT 7: note = X can be any amino acid
  VARIANT 9..10: note = X can be any amino acid
  VARIANT 12..13: note = X can be any amino acid
  VARIANT 15: note = X can be any amino acid
  VARIANT 17..18: note = X can be any amino acid
  VARIANT 20..23: note = X can be any amino acid
  VARIANT 25..26: note = X can be any amino acid
  VARIANT 28..40: note = X can be any amino acid
  VARIANT 42..43: note = X can be any amino acid
  VARIANT 45: note = X can be any amino acid
  VARIANT 48..52: note = X can be any amino acid
  VARIANT 54..55: note = X can be any amino acid
  VARIANT 58..59: note = X can be any amino acid
  VARIANT 61..69: note = X can be any amino acid
  VARIANT 72..73: note = X can be any amino acid
  VARIANT 76: note = X can be any amino acid
  VARIANT 79..118: note = X can be any amino acid
  VARIANT 120: note = X can be any amino acid
  VARIANT 123: note = X can be any amino acid
  VARIANT 125: note = X can be any amino acid
  VARIANT 128..129: note = X can be any amino acid
  VARIANT 132..137: note = X can be any amino acid
  VARIANT 139..151: note = X can be any amino acid
  VARIANT 153: note = X can be any amino acid
  VARIANT 159..161: note = X can be any amino acid
  VARIANT 163..190: note = X can be any amino acid
  VARIANT 192..193: note = X can be any amino acid
  VARIANT 196..206: note = X can be any amino acid
  VARIANT 209..219: note = X can be any amino acid
  VARIANT 222..223: note = X can be any amino acid
  VARIANT 226..237: note = X can be any amino acid
YKXXXIXKXXGXXRXIXXPXXXXKXXQXXXXXXXXXXXXXHXXAXAYXXXXXIXXNAXXHXXXXXXXXXDFXXFFXSIXXXXXXXXXXXXXXXXXXXXXXXXXXXXXXXXXXXXXXXXLXIGXPXSPXXSNXXXXXXDXXXXXXXXXXXXXYXRYADDXXXSXXXXXXXXXXXXXXXXXXXXXXXXXXXXNXXKTXXXXXXXXXXXTGXXXXXXXXXXXGRXXKRXXXXXXXXXXXX

SEQ ID NO: 19111 - protein, 230 aa, synthetic construct
  VARIANT 1..17: note = X can be any amino acid
  VARIANT 20..23: note = X can be any amino acid
  VARIANT 25..39: note = X can be any amino acid
  VARIANT 41: note = X can be any amino acid
  VARIANT 47..51: note = X can be any amino acid
  VARIANT 54..55: note = X can be any amino acid
  VARIANT 57..61: note = X can be any amino acid
  VARIANT 63..65: note = X can be any amino acid
  VARIANT 67..69: note = X can be any amino acid
  VARIANT 72: note = X can be any amino acid
  VARIANT 75..90: note = X can be any amino acid
  VARIANT 92..93: note = X can be any amino acid
  VARIANT 95..111: note = X can be any amino acid
  VARIANT 114: note = X can be any amino acid
  VARIANT 116..117: note = X can be any amino acid
  VARIANT 121..122: note = X can be any amino acid
  VARIANT 125..126: note = X can be any amino acid
  VARIANT 128..129: note = X can be any amino acid
  VARIANT 132..137: note = X can be any amino acid
  VARIANT 139..144: note = X can be any amino acid
  VARIANT 149: note = X can be any amino acid
  VARIANT 152: note = X can be any amino acid
  VARIANT 154: note = X can be any amino acid
  VARIANT 156..172: note = X can be any amino acid
  VARIANT 174..186: note = X can be any amino acid
  VARIANT 188: note = X can be any amino acid
  VARIANT 190..193: note = X can be any amino acid
  VARIANT 195..197: note = X can be any amino acid
  VARIANT 199: note = X can be any amino acid
  VARIANT 202..203: note = X can be any amino acid
  VARIANT 207: note = X can be any amino acid
  VARIANT 209..216: note = X can be any amino acid
  VARIANT 218..220: note = X can be any amino acid
  VARIANT 222..230: note = X can be any amino acid
XXXXXXXXXXXXXXXXXLKXXXXFXXXXXXXXXXXXXXXVXSYRKGXXXXXAVXXHXXXXXFXXXDXXXFFXSIXXXXXXXXXXXXXXXXPXXDXXXXXXXXXXXXXXXXXLPXGXXTSPXXSNXXLXXFDXXXXXXCXXXXXXYTRYXDDXIXSXXXXXXXXXXXXXXXXXLXXXXXXXXXXNXXKXKXXXXGXXXKXLGXXILPXGXXXXXXXXKXXXEXXXXXXXXX

SEQ ID NO: 19112 - protein, 241 aa, synthetic construct
  VARIANT 1..51: note = X can be any amino acid
  VARIANT 54..59: note = X can be any amino acid
  VARIANT 61..67: note = X can be any amino acid
  VARIANT 69: note = X can be any amino acid
  VARIANT 72..73: note = X can be any amino acid
  VARIANT 76: note = X can be any amino acid
  VARIANT 79..124: note = X can be any amino acid
  VARIANT 126: note = X can be any amino acid
  VARIANT 128..130: note = X can be any amino acid
  VARIANT 133..134: note = X can be any amino acid
  VARIANT 137..138: note = X can be any amino acid
  VARIANT 141..142: note = X can be any amino acid
  VARIANT 144..145: note = X can be any amino acid
  VARIANT 147..149: note = X can be any amino acid
  VARIANT 151..156: note = X can be any amino acid
  VARIANT 158: note = X can be any amino acid
  VARIANT 164: note = X can be any amino acid
  VARIANT 168..179: note = X can be any amino acid
  VARIANT 181..183: note = X can be any amino acid
  VARIANT 185..195: note = X can be any amino acid
  VARIANT 197..198: note = X can be any amino acid
  VARIANT 200..207: note = X can be any amino acid
  VARIANT 212..223: note = X can be any amino acid
  VARIANT 225..226: note = X can be any amino acid
  VARIANT 228..241: note = X can be any amino acid
XXXXXXXXXXXXXXXXXXXXXXXXXXXXXXXXXXXXXXXXXXXXXXXXXXXSYXXXXXXHXXXXXXXRXDIXXFFXSIXXXXXXXXXXXXXXXXXXXXXXXXXXXXXXXXXXXXXXXXXXXXXXPXGXXXSPXXSNXXFRXXDXXIXXXCXXXXXXYXRYADDXLFSXXXXXXXXXXXXFXXXIXXXXXXXXXXXNXXKXXXXXXXXSLNGXXXXXXXXXXXXSXXKXXXXXXXXXXXXXX

SEQ ID NO: 19113 - protein, 244 aa, synthetic construct
  VARIANT 2..3: note = X can be any amino acid
  VARIANT 5: note = X can be any amino acid
  VARIANT 7: note = X can be any amino acid
  VARIANT 9..10: note = X can be any amino acid
  VARIANT 12..13: note = X can be any amino acid
  VARIANT 15: note = X can be any amino acid
  VARIANT 17: note = X can be any amino acid
  VARIANT 20..22: note = X can be any amino acid
  VARIANT 25..26: note = X can be any amino acid
  VARIANT 28..29: note = X can be any amino acid
  VARIANT 31..33: note = X can be any amino acid
  VARIANT 35..52: note = X can be any amino acid
  VARIANT 54: note = X can be any amino acid
  VARIANT 56..60: note = X can be any amino acid
  VARIANT 62..63: note = X can be any amino acid
  VARIANT 66..67: note = X can be any amino acid
  VARIANT 69..73: note = X can be any amino acid
  VARIANT 75: note = X can be any amino acid
  VARIANT 77: note = X can be any amino acid
  VARIANT 80..81: note = X can be any amino acid
  VARIANT 84..87: note = X can be any amino acid
  VARIANT 92: note = X can be any amino acid
  VARIANT 94: note = X can be any amino acid
  VARIANT 96..100: note = X can be any amino acid
  VARIANT 102..107: note = X can be any amino acid
  VARIANT 109..111: note = X can be any amino acid
  VARIANT 114..115: note = X can be any amino acid
  VARIANT 117..120: note = X can be any amino acid
  VARIANT 125: note = X can be any amino acid
  VARIANT 127: note = X can be any amino acid
  VARIANT 130: note = X can be any amino acid
  VARIANT 132: note = X can be any amino acid
  VARIANT 134: note = X can be any amino acid
  VARIANT 136..138: note = X can be any amino acid
  VARIANT 141..146: note = X can be any amino acid
  VARIANT 148..153: note = X can be any amino acid
  VARIANT 155: note = X can be any amino acid
  VARIANT 161: note = X can be any amino acid
  VARIANT 166..195: note = X can be any amino acid
  VARIANT 198..199: note = X can be any amino acid
  VARIANT 201..202: note = X can be any amino acid
  VARIANT 206..211: note = X can be any amino acid
  VARIANT 214: note = X can be any amino acid
  VARIANT 219: note = X can be any amino acid
  VARIANT 222..224: note = X can be any amino acid
  VARIANT 226..229: note = X can be any amino acid
  VARIANT 231..234: note = X can be any amino acid
  VARIANT 236..244: note = X can be any amino acid
YXXFXIXKXXGXXRXIXAPXXXLKXXQXXLXXXLXXXXXXXXXXXXXXXXXXHXFXXXXXIXXNAXXHXXXXXVXNXDLXXFFXXXXFGRVXGXFXXXXXFXXXXXXAXXXAQXXCXXXXLPQGXPXSPXIXNXIXXXLDXXXXXXAXXXXXXYXRYADDXTFSTXXXXXXXXXXXXXXXXXXXXXXXXXXXXXXGFXXNXXKTRXXXXXXRQXVTGLXVNXXXNXXXXYXXXXRXXXXXXXXX

SEQ ID NO: 19114 - protein, 233 aa, synthetic construct
  VARIANT 2..7: note = X can be any amino acid
  VARIANT 10: note = X can be any amino acid
  VARIANT 13: note = X can be any amino acid
  VARIANT 15: note = X can be any amino acid
  VARIANT 17..18: note = X can be any amino acid
  VARIANT 20..22: note = X can be any amino acid
  VARIANT 24..26: note = X can be any amino acid
  VARIANT 28..29: note = X can be any amino acid
  VARIANT 31..33: note = X can be any amino acid
  VARIANT 35..37: note = X can be any amino acid
  VARIANT 39..47: note = X can be any amino acid
  VARIANT 50..61: note = X can be any amino acid
  VARIANT 63..64: note = X can be any amino acid
  VARIANT 67..68: note = X can be any amino acid
  VARIANT 70..71: note = X can be any amino acid
  VARIANT 73..75: note = X can be any amino acid
  VARIANT 78: note = X can be any amino acid
  VARIANT 80..82: note = X can be any amino acid
  VARIANT 85: note = X can be any amino acid
  VARIANT 88..100: note = X can be any amino acid
  VARIANT 102..107: note = X can be any amino acid
  VARIANT 109..112: note = X can be any amino acid
  VARIANT 115: note = X can be any amino acid
  VARIANT 117..120: note = X can be any amino acid
  VARIANT 123: note = X can be any amino acid
  VARIANT 127: note = X can be any amino acid
  VARIANT 130..131: note = X can be any amino acid
  VARIANT 134..135: note = X can be any amino acid
  VARIANT 137..139: note = X can be any amino acid
  VARIANT 141..142: note = X can be any amino acid
  VARIANT 144..153: note = X can be any amino acid
  VARIANT 155: note = X can be any amino acid
  VARIANT 165..180: note = X can be any amino acid
  VARIANT 182..185: note = X can be any amino acid
  VARIANT 187..188: note = X can be any amino acid
  VARIANT 190: note = X can be any amino acid
  VARIANT 193: note = X can be any amino acid
  VARIANT 195..201: note = X can be any amino acid
  VARIANT 203: note = X can be any amino acid
  VARIANT 207..208: note = X can be any amino acid
  VARIANT 211: note = X can be any amino acid
  VARIANT 213: note = X can be any amino acid
  VARIANT 215..216: note = X can be any amino acid
  VARIANT 218..223: note = X can be any amino acid
  VARIANT 226..227: note = X can be any amino acid
  VARIANT 229..233: note = X can be any amino acid
YXXXXXXKKXGGXRXIXXPXXXLXXXQXXLXXXLXXXYXXXXXXXXXGFXXXXXXXXXXXXIXXNAXXHXXKXXXLNXDXXXFFXSIXXXXXXXXXXXXXFXXXXXXAXXXXLLXTXXXXLPXGAPXSPXXSNXXCXXXDXXLXXXXXXXXXXYXRYADDLTFSXXXXXXXXXXXXXXXXIXXXXFXXNXKKXRXXXXXXXQXVTGXXVNXKXNXXRXXXXXXRAXXHXXXXX

SEQ ID NO: 19115 - protein, 233 aa, synthetic construct; identical to SEQ ID NO: 19114
  VARIANT 2..7: note = X can be any amino acid
  VARIANT 10: note = X can be any amino acid
  VARIANT 13: note = X can be any amino acid
  VARIANT 15: note = X can be any amino acid
  VARIANT 17..18: note = X can be any amino acid
  VARIANT 20..22: note = X can be any amino acid
  VARIANT 24..26: note = X can be any amino acid
  VARIANT 28..29: note = X can be any amino acid
  VARIANT 31..33: note = X can be any amino acid
  VARIANT 35..37: note = X can be any amino acid
  VARIANT 39..47: note = X can be any amino acid
  VARIANT 50..61: note = X can be any amino acid
  VARIANT 63..64: note = X can be any amino acid
  VARIANT 67..68: note = X can be any amino acid
  VARIANT 70..71: note = X can be any amino acid
  VARIANT 73..75: note = X can be any amino acid
  VARIANT 78: note = X can be any amino acid
  VARIANT 80..82: note = X can be any amino acid
  VARIANT 85: note = X can be any amino acid
  VARIANT 88..100: note = X can be any amino acid
  VARIANT 102..107: note = X can be any amino acid
  VARIANT 109..112: note = X can be any amino acid
  VARIANT 115: note = X can be any amino acid
  VARIANT 117..120: note = X can be any amino acid
  VARIANT 123: note = X can be any amino acid
  VARIANT 127: note = X can be any amino acid
  VARIANT 130..131: note = X can be any amino acid
  VARIANT 134..135: note = X can be any amino acid
  VARIANT 137..139: note = X can be any amino acid
  VARIANT 141..142: note = X can be any amino acid
  VARIANT 144..153: note = X can be any amino acid
  VARIANT 155: note = X can be any amino acid
  VARIANT 165..180: note = X can be any amino acid
  VARIANT 182..185: note = X can be any amino acid
  VARIANT 187..188: note = X can be any amino acid
  VARIANT 190: note = X can be any amino acid
  VARIANT 193: note = X can be any amino acid
  VARIANT 195..201: note = X can be any amino acid
  VARIANT 203: note = X can be any amino acid
  VARIANT 207..208: note = X can be any amino acid
  VARIANT 211: note = X can be any amino acid
  VARIANT 213: note = X can be any amino acid
  VARIANT 215..216: note = X can be any amino acid
  VARIANT 218..223: note = X can be any amino acid
  VARIANT 226..227: note = X can be any amino acid
  VARIANT 229..233: note = X can be any amino acid

SEQ ID NO: 19116 - protein, 227 aa, synthetic construct
  VARIANT 2..13: note = X can be any amino acid
  VARIANT 15..18: note = X can be any amino acid
  VARIANT 20..22: note = X can be any amino acid
  VARIANT 25..26: note = X can be any amino acid
  VARIANT 28: note = X can be any amino acid
  VARIANT 30..45: note = X can be any amino acid
  VARIANT 48..51: note = X can be any amino acid
  VARIANT 53..56: note = X can be any amino acid
  VARIANT 58..59: note = X can be any amino acid
  VARIANT 61..69: note = X can be any amino acid
  VARIANT 72..73: note = X can be any amino acid
  VARIANT 76: note = X can be any amino acid
  VARIANT 78..113: note = X can be any amino acid
  VARIANT 115..116: note = X can be any amino acid
  VARIANT 118..120: note = X can be any amino acid
  VARIANT 123: note = X can be any amino acid
  VARIANT 125: note = X can be any amino acid
  VARIANT 127..128: note = X can be any amino acid
  VARIANT 130..132: note = X can be any amino acid
  VARIANT 134..146: note = X can be any amino acid
  VARIANT 148: note = X can be any amino acid
  VARIANT 151: note = X can be any amino acid
  VARIANT 155..156: note = X can be any amino acid
  VARIANT 159..161: note = X can be any amino acid
  VARIANT 163..173: note = X can be any amino acid
  VARIANT 175..181: note = X can be any amino acid
  VARIANT 183..184: note = X can be any amino acid
  VARIANT 187..197: note = X can be any amino acid
  VARIANT 200..209: note = X can be any amino acid
  VARIANT 211..221: note = X can be any amino acid
  VARIANT 223..227: note = X can be any amino acid
YXXXXXXXXXXXXRXXXXPXXXLKXXQXWXXXXXXXXXXXXXXXXAYXXXXSXXXXAXXHXXXXXXXXXDIXXFFXSXXXXXXXXXXXXXXXXXXXXXXXXXXXXXXXXXXXXLXXGXXXSPXIXNXXMXXXDXXXXXXXXXXXXXYXRYXDDIXXSSXXXIXXXXXXXXXXXLXXXXXXXNXXKTXXXXXXXXXXXTGXXXXXXXXXXGXXXXXXXXXXXYXXXXX

SEQ ID NO: 19117 - protein, 222 aa, synthetic construct
  VARIANT 3: note = X can be any amino acid
  VARIANT 5..7: note = X can be any amino acid
  VARIANT 9..10: note = X can be any amino acid
  VARIANT 12..13: note = X can be any amino acid
  VARIANT 15: note = X can be any amino acid
  VARIANT 17..18: note = X can be any amino acid
  VARIANT 21: note = X can be any amino acid
  VARIANT 23: note = X can be any amino acid
  VARIANT 25..26: note = X can be any amino acid
  VARIANT 28..31: note = X can be any amino acid
  VARIANT 33..34: note = X can be any amino acid
  VARIANT 36..37: note = X can be any amino acid
  VARIANT 39..40: note = X can be any amino acid
  VARIANT 42..51: note = X can be any amino acid
  VARIANT 53..55: note = X can be any amino acid
  VARIANT 58..59: note = X can be any amino acid
  VARIANT 61..69: note = X can be any amino acid
  VARIANT 72..74: note = X can be any amino acid
  VARIANT 76..77: note = X can be any amino acid
  VARIANT 79..109: note = X can be any amino acid
  VARIANT 119..120: note = X can be any amino acid
  VARIANT 123..124: note = X can be any amino acid
  VARIANT 126..127: note = X can be any amino acid
  VARIANT 130..142: note = X can be any amino acid
  VARIANT 144: note = X can be any amino acid
  VARIANT 147: note = X can be any amino acid
  VARIANT 150: note = X can be any amino acid
  VARIANT 152: note = X can be any amino acid
  VARIANT 154..170: note = X can be any amino acid
  VARIANT 172..178: note = X can be any amino acid
  VARIANT 180..181: note = X can be any amino acid
  VARIANT 183: note = X can be any amino acid
  VARIANT 185..191: note = X can be any amino acid
  VARIANT 193: note = X can be any amino acid
  VARIANT 197..199: note = X can be any amino acid
  VARIANT 201..204: note = X can be any amino acid
  VARIANT 206: note = X can be any amino acid
  VARIANT 208..209: note = X can be any amino acid
  VARIANT 211..213: note = X can be any amino acid
  VARIANT 216..219: note = X can be any amino acid
  VARIANT 221..222: note = X can be any amino acid
YRXFXXXKXXGXXRXIXXPRXFXKXXQXXXXDXXLXXLXXHXXXXXXXXXXSXXXNAXXHXXXXXXXXXDIXXXFXXIXXXXXXXXXXXXXXXXXXXXXXXXXXTXXXXLPQGAPTSPXXSNXXLXXFDXXXXXXXXXXXXXYXRYXDDXTXSXXXXXXXXXXXXXXXXXLXXXXXXXNXXKXRXXXXXXXQXVTGXXXNXXXXPXRXXRXXXRAXXXXAXX

SEQ ID NO: 19118 - protein, 222 aa, synthetic construct
  VARIANT 2..7: note = X can be any amino acid
  VARIANT 9..13: note = X can be any amino acid
  VARIANT 15: note = X can be any amino acid
  VARIANT 17..18: note = X can be any amino acid
  VARIANT 20..22: note = X can be any amino acid
  VARIANT 25..26: note = X can be any amino acid
  VARIANT 28: note = X can be any amino acid
  VARIANT 32..33: note = X can be any amino acid
  VARIANT 36..40: note = X can be any amino acid
  VARIANT 42..46: note = X can be any amino acid
  VARIANT 48..50: note = X can be any amino acid
  VARIANT 51..55: note = X can be any amino acid
  VARIANT 58..59: note = X can be any amino acid
  VARIANT 61..66: note = X can be any amino acid
  VARIANT 68..69: note = X can be any amino acid
  VARIANT 71..73: note = X can be any amino acid
  VARIANT 76..82: note = X can be any amino acid
  VARIANT 84..86: note = X can be any amino acid
  VARIANT 88..90: note = X can be any amino acid
  VARIANT 93..99: note = X can be any amino acid
  VARIANT 101..103: note = X can be any amino acid
  VARIANT 105..109: note = X can be any amino acid
  VARIANT 114..116: note = X can be any amino acid
  VARIANT 119..121: note = X can be any amino acid
  VARIANT 124..127: note = X can be any amino acid
  VARIANT 130: note = X can be any amino acid
  VARIANT 132..142: note = X can be any amino acid
  VARIANT 150..152: note = X can be any amino acid
  VARIANT 154..169: note = X can be any amino acid
  VARIANT 171..173: note = X can be any amino acid
  VARIANT 175..178: note = X can be any amino acid
  VARIANT 180..181: note = X can be any amino acid
  VARIANT 183..194: note = X can be any amino acid
  VARIANT 197..222: note = X can be any amino acid
YXXXXXXKXXXXXRXIXXPXXXLKXXQXWILXXILXXXXXSXXXXXFXXXXXXXXNAXXHXXXXXXLXXDXXXFFXXXXXXXVXXXFXXXGYXXXXXXXLXXXCXXXXXLPQGXXXSPXXXNLXXXXLDXRXXXXXXXXXXXYTRYADDXXXSXXXXXXXXXXXXXXXXIXXXEXXXXNXXKXXXXXXXXXXXXTGXXXXXXXXXXXXXXXXXRXXXXXXXX

SEQ ID NO: 19119 - protein, 248 aa, synthetic construct
  VARIANT 1..5: note = X can be any amino acid
  VARIANT 7..12: note = X can be any amino acid
  VARIANT 16: note = X can be any amino acid
  VARIANT 18..28: note = X can be any amino acid
  VARIANT 30..44: note = X can be any amino acid
  VARIANT 46: note = X can be any amino acid
  VARIANT 50..53: note = X can be any amino acid
  VARIANT 56..57: note = X can be any amino acid
  VARIANT 60..61: note = X can be any amino acid
  VARIANT 67: note = X can be any amino acid
  VARIANT 69..71: note = X can be any amino acid
  VARIANT 74..75: note = X can be any amino acid
  VARIANT 78..79: note = X can be any amino acid
  VARIANT 81: note = X can be any amino acid
  VARIANT 83..84: note = X can be any amino acid
  VARIANT 86..88: note = X can be any amino acid
  VARIANT 90..118: note = X can be any amino acid
  VARIANT 121..122: note = X can be any amino acid
  VARIANT 124..126: note = X can be any amino acid
  VARIANT 129: note = X can be any amino acid
  VARIANT 131: note = X can be any amino acid
  VARIANT 133: note = X can be any amino acid
  VARIANT 135: note = X can be any amino acid
  VARIANT 137: note = X can be any amino acid
  VARIANT 140: note = X can be any amino acid
  VARIANT 142: note = X can be any amino acid
  VARIANT 145: note = X can be any amino acid
  VARIANT 148..154: note = X can be any amino acid
  VARIANT 163..164: note = X can be any amino acid
  VARIANT 169..179: note = X can be any amino acid
  VARIANT 181..192: note = X can be any amino acid
  VARIANT 194..195: note = X can be any amino acid
  VARIANT 197..198: note = X can be any amino acid
  VARIANT 200..207: note = X can be any amino acid
  VARIANT 212: note = X can be any amino acid
  VARIANT 216..217: note = X can be any amino acid
  VARIANT 219..225: note = X can be any amino acid
  VARIANT 227..229: note = X can be any amino acid
  VARIANT 232..237: note = X can be any amino acid
  VARIANT 239..241: note = X can be any amino acid
  VARIANT 243..248: note = X can be any amino acid
XXXXXIXXXXXXRKIXTXXXXXXXXXXXHXXXXXXXXXXXXXXXFXKAYXXXXSIXXNAXXHMYNDXFXXXDIXXFFXXIXHXXLXXXLXXXXXXXXXXXXXXXXXXXXXXXXXXXXXGLXXGXXXSPXLXNXYXKXFDXIXYGXLKXXXXXXXIYTRYADDXXISFKXXXXXXXXXXXIXXXXXXXLXXXXLXXNXXKXXXXXXXXSNHVXITGXXIXXXXXXXRXXXVGXXXXXXLXXXAXXXXXX

SEQ ID NO: 19120 - protein, 242 aa, synthetic construct
  VARIANT 1..10: note = X can be any amino acid
  VARIANT 12: note = X can be any amino acid
  VARIANT 14..23: note = X can be any amino acid
  VARIANT 25..29: note = X can be any amino acid
  VARIANT 30: note = X can be any amino acid
  VARIANT 32..47: note = X can be any amino acid
  VARIANT 52..55: note = X can be any amino acid
  VARIANT 58..59: note = X can be any amino acid
  VARIANT 61..63: note = X can be any amino acid
  VARIANT 65..69: note = X can be any amino acid
  VARIANT 71: note = X can be any amino acid
  VARIANT 73: note = X can be any amino acid
  VARIANT 76..77: note = X can be any amino acid
  VARIANT 83..86: note = X can be any amino acid
  VARIANT 88..118: note = X can be any amino acid
  VARIANT 120: note = X can be any amino acid
  VARIANT 127..128: note = X can be any amino acid
  VARIANT 131: note = X can be any amino acid
  VARIANT 133..150: note = X can be any amino acid
  VARIANT 159: note = X can be any amino acid
  VARIANT 162..173: note = X can be any amino acid
  VARIANT 175..181: note = X can be any amino acid
  VARIANT 183..186: note = X can be any amino acid
  VARIANT 188..189: note = X can be any amino acid
  VARIANT 191..192: note = X can be any amino acid
  VARIANT 194..209: note = X can be any amino acid
  VARIANT 211: note = X can be any amino acid
  VARIANT 214..223: note = X can be any amino acid
  VARIANT 226..242: note = X can be any amino acid
XXXXXXXXXXKXRXXXXXXXXXXGXXXXXXHXXXXXXXXXXXXXXXXSYAYXXXXSIXXCXXXHXXXXXFXKXDIXXFFNSIXXXXLXXXXXXXXXXXXXXXXXXXXXXXXXXXXXXXPXGLXXSPXXSDXYXXXXXXXXXXXXXXXXXXYTRYADDIXISXXXXXXXXXXXXIXXXXXXXLXXXXLXXNXXKXXXXXXXXXXXXXXXXGXNIXXXXXXXXXXVGXXXXXXXXXXXXXXXXX

SEQ ID NO: 19121 - protein, 222 aa, synthetic construct
  VARIANT 3: note = X can be any amino acid
  VARIANT 5..7: note = X can be any amino acid
  VARIANT 9..10: note = X can be any amino acid
  VARIANT 12..13: note = X can be any amino acid
  VARIANT 15: note = X can be any amino acid
  VARIANT 17..18: note = X can be any amino acid
  VARIANT 20: note = X can be any amino acid
  VARIANT 26: note = X can be any amino acid
  VARIANT 31: note = X can be any amino acid
  VARIANT 33: note = X can be any amino acid
  VARIANT 35..45: note = X can be any amino acid
  VARIANT 48..49: note = X can be any amino acid
  VARIANT 51..55: note = X can be any amino acid
  VARIANT 58..59: note = X can be any amino acid
  VARIANT 61..66: note = X can be any amino acid
  VARIANT 69: note = X can be any amino acid
  VARIANT 71..73: note = X can be any amino acid
  VARIANT 76: note = X can be any amino acid
  VARIANT 78..86: note = X can be any amino acid
  VARIANT 88..90: note = X can be any amino acid
  VARIANT 92..99: note = X can be any amino acid
  VARIANT 101..102: note = X can be any amino acid
  VARIANT 104..110: note = X can be any amino acid
  VARIANT 112: note = X can be any amino acid
  VARIANT 119..121: note = X can be any amino acid
  VARIANT 123..128: note = X can be any amino acid
  VARIANT 130..131: note = X can be any amino acid
  VARIANT 133..142: note = X can be any amino acid
  VARIANT 144: note = X can be any amino acid
  VARIANT 150: note = X can be any amino acid
  VARIANT 154..173: note = X can be any amino acid
  VARIANT 176..180: note = X can be any amino acid
  VARIANT 183..185: note = X can be any amino acid
  VARIANT 187..189: note = X can be any amino acid
  VARIANT 191..192: note = X can be any amino acid
  VARIANT 196..198: note = X can be any amino acid
  VARIANT 200..208: note = X can be any amino acid
  VARIANT 210..212: note = X can be any amino acid
  VARIANT 214..216: note = X can be any amino acid
  VARIANT 218..222: note = X can be any amino acid
YRXFXXXKXXGXXRXIXXPXTYLKVXQWWIXDXIXXXXXXXXXXXGFXXGXXXXXNAXXHXXXXXXLNXDXXXFFXSXXXXXXXXXFXXXGXXXXXXXXLXXLXXXXXXXPXGAPTSPXXXNXXXXXXDXXLXXXXXXXXXXYXRYADDXTFSXXXXXXXXXXXXXXXXXXXXGFXXXXXKTXXXGXXXRXXVTGXXXNXXXXXXXXXRXXXRXXXHXXXXX

SEQ ID NO: 19122 - protein, 220 aa, synthetic construct
  VARIANT 3..5: note = X can be any amino acid
  VARIANT 7: note = X can be any amino acid
  VARIANT 9..10: note = X can be any amino acid
  VARIANT 12..13: note = X can be any amino acid
  VARIANT 15: note = X can be any amino acid
  VARIANT 17: note = X can be any amino acid
  VARIANT 22: note = X can be any amino acid
  VARIANT 25: note = X can be any amino acid
  VARIANT 28: note = X can be any amino acid
  VARIANT 32..33: note = X can be any amino acid
  VARIANT 36..40: note = X can be any amino acid
  VARIANT 42..43: note = X can be any amino acid
  VARIANT 47..55: note = X can be any amino acid
  VARIANT 57..59: note = X can be any amino acid
  VARIANT 61..69: note = X can be any amino acid
  VARIANT 71..73: note = X can be any amino acid
  VARIANT 76..77: note = X can be any amino acid
  VARIANT 79..86: note = X can be any amino acid
  VARIANT 88..90: note = X can be any amino acid
  VARIANT 93..99: note = X can be any amino acid
  VARIANT 101..102: note = X can be any amino acid
  VARIANT 105..109: note = X can be any amino acid
  VARIANT 119: note = X can be any amino acid
  VARIANT 123..128: note = X can be any amino acid
  VARIANT 130..142: note = X can be any amino acid
  VARIANT 150..151: note = X can be any amino acid
  VARIANT 155..179: note = X can be any amino acid
  VARIANT 181..189: note = X can be any amino acid
  VARIANT 191: note = X can be any amino acid
  VARIANT 195: note = X can be any amino acid
  VARIANT 199: note = X can be any amino acid
  VARIANT 201: note = X can be any amino acid
  VARIANT 203..207: note = X can be any amino acid
  VARIANT 209..211: note = X can be any amino acid
  VARIANT 213..217: note = X can be any amino acid
  VARIANT 219: note = X can be any amino acid
YRXXXIXKXXGXXRXIXEPLPXLKXIQXWILXXILXXXXXSXXAKAXXXXXXXXXNXXXHXXXXXXXXXDXXXFFXXIXXXXXXXXFXXXGYXXXXXXXLXXLCXXXXXLPQGAPTSPXLSNXXXXXXDXXXXXXXXXXXXXYTRYADDXXFSGXXXXXXXXXXXXXXXXXXXXXXNXXKXXXXXXXXXQXVTGXVVNXKXQXXXXXRXXXRXXXXXIXK

SEQ ID NO: 19123 - protein, 222 aa, synthetic construct
  VARIANT 3: note = X can be any amino acid
  VARIANT 5: note = X can be any amino acid
  VARIANT 7: note = X can be any amino acid
  VARIANT 9..10: note = X can be any amino acid
  VARIANT 13: note = X can be any amino acid
  VARIANT 15: note = X can be any amino acid
  VARIANT 17..18: note = X can be any amino acid
  VARIANT 20..22: note = X can be any amino acid
  VARIANT 24..26: note = X can be any amino acid
  VARIANT 28..29: note = X can be any amino acid
  VARIANT 31..33: note = X can be any amino acid
  VARIANT 36..51: note = X can be any amino acid
  VARIANT 53..55: note = X can be any amino acid
  VARIANT 58..59: note = X can be any amino acid
  VARIANT 61..66: note = X can be any amino acid
  VARIANT 69: note = X can be any amino acid
  VARIANT 71..73: note = X can be any amino acid
  VARIANT 76: note = X can be any amino acid
  VARIANT 79..86: note = X can be any amino acid
  VARIANT 88..90: note = X can be any amino acid
  VARIANT 93..99: note = X can be any amino acid
  VARIANT 101..103: note = X can be any amino acid
  VARIANT 105..109: note = X can be any amino acid
  VARIANT 115: note = X can be any amino acid
  VARIANT 119: note = X can be any amino acid
  VARIANT 123..128: note = X can be any amino acid
  VARIANT 130..131: note = X can be any amino acid
  VARIANT 133..142: note = X can be any amino acid
  VARIANT 144: note = X can be any amino acid
  VARIANT 150..152: note = X can be any amino acid
  VARIANT 155..172: note = X can be any amino acid
  VARIANT 174..176: note = X can be any amino acid
  VARIANT 178..179: note = X can be any amino acid
  VARIANT 181..190: note = X can be any amino acid
  VARIANT 192: note = X can be any amino acid
  VARIANT 195..204: note = X can be any amino acid
  VARIANT 206..209: note = X can be any amino acid
  VARIANT 211..222: note = X can be any amino acid
YRXFXIXKXXGGXRXIXXPXXXLXXXQXXIXXXILXXXXXXXXXXXXXXXXSXXXNAXXHXXXXXXLKXDXXXFFXSIXXXXXXXXFXXXGYXXXXXXXLXXXCXXXXXLPQGAXTSPXLSNXXXXXXDXXLXXXXXXXXXXYXRYADDXXXSGXXXXXXXXXXXXXXXXXXGXXXNXXKXXXXXXXXXXIXTGXXXXXXXXXXPXXXXRXXXXXXXXXXXX

SEQ ID NO: 19124 - protein, 252 aa, synthetic construct
  VARIANT 2..7: note = X can be any amino acid
  VARIANT 9..13: note = X can be any amino acid
  VARIANT 15: note = X can be any amino acid
  VARIANT 17..18: note = X can be any amino acid
  VARIANT 20..22: note = X can be any amino acid
  VARIANT 24..26: note = X can be any amino acid
  VARIANT 28..29: note = X can be any amino acid
  VARIANT 31..34: note = X can be any amino acid
  VARIANT 36..40: note = X can be any amino acid
  VARIANT 42..45: note = X can be any amino acid
  VARIANT 47..56: note = X can be any amino acid
  VARIANT 58..59: note = X can be any amino acid
  VARIANT 61..64: note = X can be any amino acid
  VARIANT 66..67: note = X can be any amino acid
  VARIANT 69: note = X can be any amino acid
  VARIANT 71..73: note = X can be any amino acid
  VARIANT 76..79: note = X can be any amino acid
  VARIANT 81..86: note = X can be any amino acid
  VARIANT 88..90: note = X can be any amino acid
  VARIANT 93..94: note = X can be any amino acid
  VARIANT 96..98: note = X can be any amino acid
  VARIANT 100: note = X can be any amino acid
  VARIANT 103: note = X can be any amino acid
  VARIANT 106..132: note = X can be any amino acid
  VARIANT 134: note = X can be any amino acid
  VARIANT 143..144: note = X can be any amino acid
  VARIANT 146: note = X can be any amino acid
  VARIANT 149..153: note = X can be any amino acid
  VARIANT 155..160: note = X can be any amino acid
  VARIANT 162..167: note = X can be any amino acid
  VARIANT 172: note = X can be any amino acid
  VARIANT 175..177: note = X can be any amino acid
  VARIANT 179..202: note = X can be any amino acid
  VARIANT 204..209: note = X can be any amino acid
  VARIANT 211..215: note = X can be any amino acid
  VARIANT 218..221: note = X can be any amino acid
  VARIANT 226: note = X can be any amino acid
  VARIANT 228..233: note = X can be any amino acid
  VARIANT 235..244: note = X can be any amino acid
  VARIANT 246..252: note = X can be any amino acid
YXXXXXXKXXXXXRXIXXPXXXLXXXQXXIXXXXLXXXXXHXXXXAXXXXXXXXXXAXXHXXXXWXXKXDXXXFFXXXXEXXXXXXFXXXGYXXLXXXEXARXCTXXXXXXXXXXXXXXXXXXXXXXXXXXXGXLPQGAPTSXXLXNLXXXXXDXXXXXXAXXXXXXYTRYXDDXXXSXXXXXXXXXXXXXXXXXXXXXXXXGXXXXXXKXXXXXPGXXXXVLGLXVXXXXXXLXXXXXXXXXXHXXXXXXX

SEQ ID NO: 19125 - protein, 237 aa, synthetic construct
  VARIANT 2..7: note = X can be any amino acid
  VARIANT 9..10: note = X can be any amino acid
  VARIANT 13: note = X can be any amino acid
  VARIANT 15: note = X can be any amino acid
  VARIANT 17..18: note = X can be any amino acid
  VARIANT 20..22: note = X can be any amino acid
  VARIANT 24..26: note = X can be any amino acid
  VARIANT 28: note = X can be any amino acid
  VARIANT 31..32: note = X can be any amino acid
  VARIANT 36..45: note = X can be any amino acid
  VARIANT 48..51: note = X can be any amino acid
  VARIANT 54..55: note = X can be any amino acid
  VARIANT 58..59: note = X can be any amino acid
  VARIANT 61..66: note = X can be any amino acid
  VARIANT 68..69: note = X can be any amino acid
  VARIANT 72..73: note = X can be any amino acid
  VARIANT 75..77: note = X can be any amino acid
  VARIANT 79..86: note = X can be any amino acid
  VARIANT 88..90: note = X can be any amino acid
  VARIANT 93..100: note = X can be any amino acid
  VARIANT 102..104: note = X can be any amino acid
  VARIANT 106..125: note = X can be any amino acid
  VARIANT 132: note = X can be any amino acid
  VARIANT 135..137: note = X can be any amino acid
  VARIANT 139..144: note = X can be any amino acid
  VARIANT 146: note = X can be any amino acid
  VARIANT 148..149: note = X can be any amino acid
  VARIANT 150..158: note = X can be any amino acid
  VARIANT 160: note = X can be any amino acid
  VARIANT 166: note = X can be any amino acid
  VARIANT 170..183: note = X can be any amino acid
  VARIANT 185..187: note = X can be any amino acid
  VARIANT 189..192: note = X can be any amino acid
  VARIANT 194..195: note = X can be any amino acid
  VARIANT 197..207: note = X can be any amino acid
  VARIANT 212..234: note = X can be any amino acid
  VARIANT 236: note = X can be any amino acid
YXXXXXXKXXGGXRXIXXPXXXLXXXQXWIXXNILXXXXXXXXXXGFXXXXSIXXNAXXHXXXXXXLXXDLXXFXXXIXXXXXXXXFXXXGYXXXXXXXXAXXXTXXXXXXXXXXXXXXXXXXXXLPQGAPXSPXXXNXXXXXXDXRXXXXXXXXXXXYXRYADDXTFSXXXXXXXXXXXXXXIXXXEXXXXNXXKXXXXXXXXXXXVTGLXXXXXXXXXXXXXXXXXXXXXXXCXK

SEQ ID NO: 19126 - protein, 221 aa, synthetic construct
  VARIANT 2..5: note = X can be any amino acid
  VARIANT 7: note = X can be any amino acid
  VARIANT 9..10: note = X can be any amino acid
  VARIANT 12..13: note = X can be any amino acid
  VARIANT 15..18: note = X can be any amino acid
  VARIANT 20..22: note = X can be any amino acid
  VARIANT 25..26: note = X can be any amino acid
  VARIANT 28: note = X can be any amino acid
  VARIANT 32..33: note = X can be any amino acid
  VARIANT 36..45: note = X can be any amino acid
  VARIANT 48..51: note = X can be any amino acid
  VARIANT 54..55: note = X can be any amino acid
  VARIANT 58..59: note = X can be any amino acid
  VARIANT 61..69: note = X can be any amino acid
  VARIANT 71..73: note = X can be any amino acid
  VARIANT 77: note = X can be any amino acid
  VARIANT 79..86: note = X can be any amino acid
  VARIANT 88..90: note = X can be any amino acid
  VARIANT 93..103: note = X can be any amino acid
  VARIANT 106..109: note = X can be any amino acid
  VARIANT 114: note = X can be any amino acid
  VARIANT 116: note = X can be any amino acid
  VARIANT 119..121: note = X can be any amino acid
  VARIANT 123..128: note = X can be any amino acid
  VARIANT 130: note = X can be any amino acid
  VARIANT 132..142: note = X can be any amino acid
  VARIANT 144: note = X can be any amino acid
  VARIANT 150: note = X can be any amino acid
  VARIANT 152: note = X can be any amino acid
  VARIANT 155..167: note = X can be any amino acid
  VARIANT 169..179: note = X can be any amino acid
  VARIANT 181..189: note = X can be any amino acid
  VARIANT 191: note = X can be any amino acid
  VARIANT 195..196: note = X can be any amino acid
  VARIANT 199..214: note = X can be any amino acid
  VARIANT 217..219: note = X can be any amino acid
  VARIANT 221: note = X can be any amino acid
YXXXXIXKXXGXXRXXXXPXXXLKXXQXWILXXILXXXXXXXXXXGFXXXXSIXXNAXXHXXXXXXXXXDXXXFFPXIXXXXXXXXFXXXGYXXXXXXXXXXXCTXXXXLPQGXPXSPXXXNXXXXXXDXRXXXXXXXXXXXYXRYADDXTXSGXXXXXXXXXXXXXIXXXXXXXXNXXKXXXXXXXXXQXVTGXXVNXXXXXXXXXXXXXXXXIYXXXKX

SEQ ID NO: 19127 - protein, 222 aa, synthetic construct
  VARIANT 2..13: note = X can be any amino acid
  VARIANT 15..18: note = X can be any amino acid
  VARIANT 20..22: note = X can be any amino acid
  VARIANT 25..26: note = X can be any amino acid
  VARIANT 28: note = X can be any amino acid
  VARIANT 31..32: note = X can be any amino acid
  VARIANT 36..51: note = X can be any amino acid
  VARIANT 54..55: note = X can be any amino acid
  VARIANT 58..59: note = X can be any amino acid
  VARIANT 61..69: note = X can be any amino acid
  VARIANT 72..73: note = X can be any amino acid
  VARIANT 76: note = X can be any amino acid
  VARIANT 79..86: note = X can be any amino acid
  VARIANT 88..110: note = X can be any amino acid
  VARIANT 112: note = X can be any amino acid
  VARIANT 115: note = X can be any amino acid
  VARIANT 117: note = X can be any amino acid
  VARIANT 120..122: note = X can be any amino acid
  VARIANT 124..129: note = X can be any amino acid
  VARIANT 131..143: note = X can be any amino acid
  VARIANT 145: note = X can be any amino acid
  VARIANT 151..153: note = X can be any amino acid
  VARIANT 155..181: note = X can be any amino acid
  VARIANT 184..194: note = X can be any amino acid
  VARIANT 197..215: note = X can be any amino acid
  VARIANT 217..218: note = X can be any amino acid
  VARIANT 221..222: note = X can be any amino acid
YXXXXXXXXXXXXRXXXXPXXXLKXXQXWIXXNILXXXXXXXXXXXXXXXXSIXXNAXXHXXXXXXXXXDIXXFFXSIXXXXXXXXFXXXXXXXXXXXXXXXXXXXXXXXLXQGXPXSPXXXNXXXXXXDXXXXXXXXXXXXXYXRYADDXXXSXXXXXXXXXXXXXXXXXXXXXXXXNXXKTXXXXXXXXXXXTGXXXXXXXXXXXXXXXXXXXEXXYCXX

SEQ ID NO: 19128 - protein, 237 aa, synthetic construct
  VARIANT 2..10: note = X can be any amino acid
  VARIANT 12..13: note = X can be any amino acid
  VARIANT 15..18: note = X can be any amino acid
  VARIANT 20..23: note = X can be any amino acid
  VARIANT 25..26: note = X can be any amino acid
  VARIANT 28: note = X can be any amino acid
  VARIANT 32: note = X can be any amino acid
  VARIANT 36..40: note = X can be any amino acid
  VARIANT 43..46: note = X can be any amino acid
  VARIANT 49: note = X can be any amino acid
  VARIANT 51..61: note = X can be any amino acid
  VARIANT 64..65: note = X can be any amino acid
  VARIANT 68..69: note = X can be any amino acid
  VARIANT 72..73: note = X can be any amino acid
  VARIANT 75..76: note = X can be any amino acid
  VARIANT 79: note = X can be any amino acid
  VARIANT 82..83: note = X can be any amino acid
  VARIANT 86: note = X can be any amino acid
  VARIANT 88..92: note = X can be any amino acid
  VARIANT 94..96: note = X can be any amino acid
  VARIANT 98..114: note = X can be any amino acid
  VARIANT 116..122: note = X can be any amino acid
  VARIANT 125..126: note = X can be any amino acid
  VARIANT 131: note = X can be any amino acid
  VARIANT 133: note = X can be any amino acid
  VARIANT 135: note = X can be any amino acid
  VARIANT 137..139: note = X can be any amino acid
  VARIANT 141..149: note = X can be any amino acid
  VARIANT 151: note = X can be any amino acid
  VARIANT 153: note = X can be any amino acid
  VARIANT 157: note = X can be any amino acid
  VARIANT 163: note = X can be any amino acid
  VARIANT 166..171: note = X can be any amino acid
  VARIANT 173..181: note = X can be any amino acid
  VARIANT 184..187: note = X can be any amino acid
  VARIANT 190: note = X can be any amino acid
  VARIANT 192..193: note = X can be any amino acid
  VARIANT 195..204: note = X can be any amino acid
  VARIANT 206: note = X can be any amino acid
  VARIANT 212..216: note = X can be any amino acid
  VARIANT 219: note = X can be any amino acid
  VARIANT 221..222: note = X can be any amino acid
  VARIANT 224..226: note = X can be any amino acid
  VARIANT 229..230: note = X can be any amino acid
  VARIANT 232..237: note = X can be any amino acid
YXXXXXXKXXGXXRXXXXPXXXXRXXQXRINXRIFXXXXXWPXXXXGSXPXXXXXXXXXXXDYXXCAXXHCXXKXXLKXDIXXFFXNXXXXXVXXXFXXXXXXXXXXXXXLXXXCXXXXXXXQGXXTSSYXAXLXLXXXEXXXXXXXXXKXLXYTRXVDDITXSSXXXXXXFXXXXXXXXXMLXXXXLPXNXXKXXXXXXXXXXLXVHGLRXXXXXPRXPXXEXXXIRXXVXXXXXX

SEQ ID NO: 19129 - protein, 236 aa, synthetic construct
  VARIANT 2..12: note = X can be any amino acid
  VARIANT 14: note = X can be any amino acid
  VARIANT 16..19: note = X can be any amino acid
  VARIANT 21..23: note = X can be any amino acid
  VARIANT 26..27: note = X can be any amino acid
  VARIANT 33..34: note = X can be any amino acid
  VARIANT 37..41: note = X can be any amino acid
  VARIANT 43: note = X can be any amino acid
  VARIANT 46: note = X can be any amino acid
  VARIANT 49..55: note = X can be any amino acid
  VARIANT 59..60: note = X can be any amino acid
  VARIANT 62..64: note = X can be any amino acid
  VARIANT 66..71: note = X can be any amino acid
  VARIANT 73: note = X can be any amino acid
  VARIANT 76..78: note = X can be any amino acid
  VARIANT 81..82: note = X can be any amino acid
  VARIANT 84..87: note = X can be any amino acid
  VARIANT 89..105: note = X can be any amino acid
  VARIANT 107..108: note = X can be any amino acid
  VARIANT 110: note = X can be any amino acid
  VARIANT 112..116: note = X can be any amino acid
  VARIANT 120: note = X can be any amino acid
  VARIANT 126: note = X can be any amino acid
  VARIANT 130..134: note = X can be any amino acid
  VARIANT 137..148: note = X can be any amino acid
  VARIANT 150: note = X can be any amino acid
  VARIANT 156: note = X can be any amino acid
  VARIANT 158: note = X can be any amino acid
  VARIANT 160..172: note = X can be any amino acid
  VARIANT 174..184: note = X can be any amino acid
  VARIANT 186..190: note = X can be any amino acid
  VARIANT 192..205: note = X can be any amino acid
  VARIANT 211..215: note = X can be any amino acid
  VARIANT 217..222: note = X can be any amino acid
  VARIANT 224..225: note = X can be any amino acid
  VARIANT 228..229: note = X can be any amino acid
  VARIANT 231..232: note = X can be any amino acid
  VARIANT 234..236: note = X can be any amino acid
YXXXXXXXXXXXKXRXXXXPXXXLKXXQKRINXXIFXXXXXPXYLXGGXXXXXXXRDYXXNXXXHXXXXXXIXLDXXXFYXXIXXXXVXXXXXXXXXFXXXVXXXLXXLXTXXXXXPQGXCTSSYXANLXXXXXEYXXXXXXXXXXXXYXRLLDDXTXSXXXXXXXXXXXXXIXXXXXXXXXXXLXXXXXKXXXXXXXXXXXXXXVTGLWXXXXXPXXXXXXRXXIRXXVXXCXXX

SEQ ID NO: 19130 - protein, 223 aa, synthetic construct
  VARIANT 1..13: note = X can be any amino acid
  VARIANT 15..22: note = X can be any amino acid
  VARIANT 24..39: note = X can be any amino acid
  VARIANT 41..54: note = X can be any amino acid
  VARIANT 57..58: note = X can be any amino acid
  VARIANT 60..68: note = X can be any amino acid
  VARIANT 70..72: note = X can be any amino acid
  VARIANT 74..112: note = X can be any amino acid
  VARIANT 114..116: note = X can be any amino acid
  VARIANT 118..147: note = X can be any amino acid
  VARIANT 150..152: note = X can be any amino acid
  VARIANT 154..180: note = X can be any amino acid
  VARIANT 182..193: note = X can be any amino acid
  VARIANT 196..223: note = X can be any amino acid
XXXXXXXXXXXXXRXXXXXXXXLXXXXXXXXXXXXXXXXPXXXXXXXXXXXXXXNAXXHXXXXXXXXXDXXXFXXXXXXXXXXXXXXXXXXXXXXXXXXXXXXXXXXXXXXXGXXXSXXXXXXXXXXXXXXXXXXXXXXXXXXXXXXDDXXXSXXXXXXXXXXXXXXXXXXXXXXXXXXXKXXXXXXXXXXXXTGXXXXXXXXXXXXXXXXXXXXXXXXXXXX

SEQ ID NO: 19131 - protein, 230 aa, synthetic construct
  VARIANT 1..15: note = X can be any amino acid
  VARIANT 17: note = X can be any amino acid
  VARIANT 21..29: note = X can be any amino acid
  VARIANT 31..33: note = X can be any amino acid
  VARIANT 35..38: note = X can be any amino acid
  VARIANT 40..47: note = X can be any amino acid
  VARIANT 50..53: note = X can be any amino acid
  VARIANT 56..57: note = X can be any amino acid
  VARIANT 60..61: note = X can be any amino acid
  VARIANT 63: note = X can be any amino acid
  VARIANT 66..67: note = X can be any amino acid
  VARIANT 69: note = X can be any amino acid
  VARIANT 71..77: note = X can be any amino acid
  VARIANT 79..81: note = X can be any amino acid
  VARIANT 87..89: note = X can be any amino acid
  VARIANT 91..98: note = X can be any amino acid
  VARIANT 100..107: note = X can be any amino acid
  VARIANT 109..110: note = X can be any amino acid
  VARIANT 112: note = X can be any amino acid
  VARIANT 115..117: note = X can be any amino acid
  VARIANT 123..124: note = X can be any amino acid
  VARIANT 127..129: note = X can be any amino acid
  VARIANT 131..136: note = X can be any amino acid
  VARIANT 138..139: note = X can be any amino acid
  VARIANT 141..142: note = X can be any amino acid
  VARIANT 145..150: note = X can be any amino acid
  VARIANT 152: note = X can be any amino acid
  VARIANT 155: note = X can be any amino acid
  VARIANT 158..160: note = X can be any amino acid
  VARIANT 162..166: note = X can be any amino acid
  VARIANT 168..180: note = X can be any amino acid
  VARIANT 182..186: note = X can be any amino acid
  VARIANT 188..190: note = X can be any amino acid
  VARIANT 193: note = X can be any amino acid
  VARIANT 196: note = X can be any amino acid
  VARIANT 198: note = X can be any amino acid
  VARIANT 204..209: note = X can be any amino acid
  VARIANT 212: note = X can be any amino acid
  VARIANT 215..216: note = X can be any amino acid
  VARIANT 218..219: note = X can be any amino acid
  VARIANT 225..230: note = X can be any amino acid
XXXXXXXXXXXXXXXRXVWEXXXXXXXXXKXXXRXXXXFXXXXXXXXPHXXXXGYXXGRXXRXNAXXHXGXXXXXXXDXXXFFPSIXXXRXXXXXXXXGXXXXXXXXLXXFXTIXXXLPLGLXXSPXXXNXXXXXXDXXLXXLAXXXXXXYXRYXDDXXXSXXXXXPXXXXXXXXXXXXXFXXXXXKXXXSKXGQXHXVTGLSXXXXXXPHXPRXXKXXLRQELXXXXXX

SEQ ID NO: 19132 - protein, 221 aa, synthetic construct
  VARIANT 1..13: note = X can be any amino acid
  VARIANT 15..44: note = X can be any amino acid
  VARIANT 47..54: note = X can be any amino acid
  VARIANT 57..58: note = X can be any amino acid
  VARIANT 60..68: note = X can be any amino acid
  VARIANT 70..72: note = X can be any amino acid
  VARIANT 75..76: note = X can be any amino acid
  VARIANT 78..103: note = X can be any amino acid
  VARIANT 105..108: note = X can be any amino acid
  VARIANT 110..111: note = X can be any amino acid
  VARIANT 113..114: note = X can be any amino acid
  VARIANT 118..120: note = X can be any amino acid
  VARIANT 122..127: note = X can be any amino acid
  VARIANT 129..142: note = X can be any amino acid
  VARIANT 145: note = X can be any amino acid
  VARIANT 148..149: note = X can be any amino acid
  VARIANT 152..175: note = X can be any amino acid
  VARIANT 177..178: note = X can be any amino acid
  VARIANT 180..185: note = X can be any amino acid
  VARIANT 187..188: note = X can be any amino acid
  VARIANT 190: note = X can be any amino acid
  VARIANT 195..201: note = X can be any amino acid
  VARIANT 204..208: note = X can be any amino acid
  VARIANT 210..212: note = X can be any amino acid
  VARIANT 214..221: note = X can be any amino acid
XXXXXXXXXXXXXRXXXXXXXXXXXXXKXXXXXXXXXXXXXXXXGFXXXXXXXXNAXXHXXXXXXXXXDXXXFFXXIXXXXXXXXXXXXXXXXXXXXXXXXXXTXXXXLXXGXXTSPXXXNXXXXXXDXXXXXXXXXXXXXXRYXDDXXFSXXXXXXXXXXXXXXXXXXXXXXXXNXXKXXXXXXGXXQXVTGLXXXXXXXPRXXXXXKXXXRXXXXXXXX

SEQ ID NO: 19133 - protein, 226 aa, synthetic construct
  VARIANT 2..7: note = X can be any amino acid
  VARIANT 10..11: note = X can be any amino acid
  VARIANT 12..14: note = X can be any amino acid
  VARIANT 17: note = X can be any amino acid
  VARIANT 19: note = X can be any amino acid
  VARIANT 21..22: note = X can be any amino acid
  VARIANT 24..31: note = X can be any amino acid
  VARIANT 34..44: note = X can be any amino acid
  VARIANT 47: note = X can be any amino acid
  VARIANT 53..55: note = X can be any amino acid
  VARIANT 58..60: note = X can be any amino acid
  VARIANT 63..64: note = X can be any amino acid
  VARIANT 66..72: note = X can be any amino acid
  VARIANT 77..78: note = X can be any amino acid
  VARIANT 81..82: note = X can be any amino acid
  VARIANT 85..86: note = X can be any amino acid
  VARIANT 89: note = X can be any amino acid
  VARIANT 90..101: note = X can be any amino acid
  VARIANT 103..105: note = X can be any amino acid
  VARIANT 107..108: note = X can be any amino acid
  VARIANT 114: note = X can be any amino acid
  VARIANT 116: note = X can be any amino acid
  VARIANT 124..126: note = X can be any amino acid
  VARIANT 128: note = X can be any amino acid
  VARIANT 131..133: note = X can be any amino acid
  VARIANT 135..137: note = X can be any amino acid
  VARIANT 139: note = X can be any amino acid
  VARIANT 142..149: note = X can be any amino acid
  VARIANT 154..155: note = X can be any amino acid
  VARIANT 160..175: note = X can be any amino acid
  VARIANT 178: note = X can be any amino acid
  VARIANT 181..183: note = X can be any amino acid
  VARIANT 186: note = X can be any amino acid
  VARIANT 188..189: note = X can be any amino acid
  VARIANT 191..192: note = X can be any amino acid
  VARIANT 194: note = X can be any amino acid
  VARIANT 199: note = X can be any amino acid
  VARIANT 201: note = X can be any amino acid
  VARIANT 203..205: note = X can be any amino acid
  VARIANT 211..212: note = X can be any amino acid
  VARIANT 214..215: note = X can be any amino acid
  VARIANT 219..224: note = X can be any amino acid
  VARIANT 226: note = X can be any amino acid
YXXXXXXKRXXXXXGEXRXVXXAXXXXXXXXHRXXXXXXXXXXXFGXHVQGFXXXRSXXXNAXXHXXXXXXXHADIXXFFXXITXXQVXXXXXXXXXXXXXAXXXAXXCTIDGXLXQGTRCSPXXXNXVCXXXDXXXLXLAXXXXXXXXRYADXXTFSGXXXXXXXXXXXXXXXXGFXLRXXXCYXQXXGXXQXVTGLXVXDXXXPRLPKXXKXXLRLXXXXXXKX

SEQ ID NO: 19134 - protein, 223 aa, synthetic construct
  VARIANT 3: note = X can be any amino acid
  VARIANT 5: note = X can be any amino acid
  VARIANT 7..13: note = X can be any amino acid
  VARIANT 15: note = X can be any amino acid
  VARIANT 17: note = X can be any amino acid
  VARIANT 20: note = X can be any amino acid
  VARIANT 22: note = X can be any amino acid
  VARIANT 25..26: note = X can be any amino acid
  VARIANT 28: note = X can be any amino acid
  VARIANT 30..43: note = X can be any amino acid
  VARIANT 45: note = X can be any amino acid
  VARIANT 48..49: note = X can be any amino acid
  VARIANT 51..55: note = X can be any amino acid
  VARIANT 58..59: note = X can be any amino acid
  VARIANT 61..62: note = X can be any amino acid
  VARIANT 64: note = X can be any amino acid
  VARIANT 66..67: note = X can be any amino acid
  VARIANT 69: note = X can be any amino acid
  VARIANT 71..73: note = X can be any amino acid
  VARIANT 76..86: note = X can be any amino acid
  VARIANT 88..90: note = X can be any amino acid
  VARIANT 93..109: note = X can be any amino acid
  VARIANT 111: note = X can be any amino acid
  VARIANT 114: note = X can be any amino acid
  VARIANT 116: note = X can be any amino acid
  VARIANT 119..120: note = X can be any amino acid
  VARIANT 123..128: note = X can be any amino acid
  VARIANT 130..144: note = X can be any amino acid
  VARIANT 150..151: note = X can be any amino acid
  VARIANT 155..174: note = X can be any amino acid
  VARIANT 176..180: note = X can be any amino acid
  VARIANT 182..187: note = X can be any amino acid
  VARIANT 189: note = X can be any amino acid
  VARIANT 199..204: note = X can be any amino acid
  VARIANT 212..213: note = X can be any amino acid
  VARIANT 216..217: note = X can be any amino acid
  VARIANT 219..223: note = X can be any amino acid
YRXFXIXXXXXXXRXIXAPXVXLKXXQXWXXXXXXXXXXXXXXVXGFXXGXXXXXAAXXHXXAXWXXSXDXXXFFXXXXXXXXXXXLXXXGYXXXXXXXXXXXXXXXXXLXQGXPXSPXXSNXXXXXXDXXXXXXXXXXXXXXXRYADDXXFSGXXXXXXXXXXXXXXXXXXXXWXXXXXKXXXXXXPXRLKVHGLLVXXXXXXLTKGYRNXXRAXXHXXXXX

SEQ ID NO: 19135 - protein, 225 aa, synthetic construct
  VARIANT 2..4: note = X can be any amino acid
  VARIANT 6..13: note = X can be any amino acid
  VARIANT 20..22: note = X can be any amino acid
  VARIANT 25..26: note = X can be any amino acid
  VARIANT 29..30: note = X can be any amino acid
  VARIANT 32..35: note = X can be any amino acid
  VARIANT 37..43: note = X can be any amino acid
  VARIANT 48..49: note = X can be any amino acid
  VARIANT 54..55: note = X can be any amino acid
  VARIANT 58..59: note = X can be any amino acid
  VARIANT 61: note = X can be any amino acid
  VARIANT 63..65: note = X can be any amino acid
  VARIANT 68..69: note = X can be any amino acid
  VARIANT 71..73: note = X can be any amino acid
  VARIANT 77..102: note = X can be any amino acid
  VARIANT 104..109: note = X can be any amino acid
  VARIANT 119: note = X can be any amino acid
  VARIANT 121: note = X can be any amino acid
  VARIANT 125..128: note = X can be any amino acid
  VARIANT 130..131: note = X can be any amino acid
  VARIANT 133..135: note = X can be any amino acid
  VARIANT 137..142: note = X can be any amino acid
  VARIANT 151: note = X can be any amino acid
  VARIANT 154..171: note = X can be any amino acid
  VARIANT 173..176: note = X can be any amino acid
  VARIANT 178..183: note = X can be any amino acid
  VARIANT 185..191: note = X can be any amino acid
  VARIANT 195: note = X can be any amino acid
  VARIANT 199: note = X can be any amino acid
  VARIANT 203..206: note = X can be any amino acid
  VARIANT 209..211: note = X can be any amino acid
  VARIANT 214: note = X can be any amino acid
  VARIANT 218..225: note = X can be any amino acid
YXXXPXXXXXXXXRWIEAPXXXLKXXQRXXLXXXXYXXXXXXXAHGFXXGRSIXXNAXXHXGXXXVVXXDXXXFFPXXXXXXXXXXXXXXXXXXXXXXXXXXLXXXXXXLPQGAPTSPXLXNLVXXXXDXXLXXXAXXXXXXYTRYADDLXFSXXXXXXXXXXXXXXXXXXIXXXXGXXXXXXKXXXXXXXQRQXVTGXVVNXXXXLPXXXRRXLRAXXXXXXXX

SEQ ID NO: 19136 - protein, 236 aa, Synthetic construct
  VARIANT 2..3: note = X can be any amino acid
  VARIANT 5: note = X can be any amino acid
  VARIANT 7: note = X can be any amino acid
  VARIANT 9..10: note = X can be any amino acid
  VARIANT 12..13: note = X can be any amino acid
  VARIANT 15: note = X can be any amino acid
  VARIANT 17..18: note = X can be any amino acid
  VARIANT 20..22: note = X can be any amino acid
  VARIANT 25..26: note = X can be any amino acid
  VARIANT 28..33: note = X can be any amino acid
  VARIANT 35..45: note = X can be any amino acid
  VARIANT 48..51: note = X can be any amino acid
  VARIANT 53..55: note = X can be any amino acid
  VARIANT 58..59: note = X can be any amino acid
  VARIANT 61..67: note = X can be any amino acid
  VARIANT 69: note = X can be any amino acid
  VARIANT 72..73: note = X can be any amino acid
  VARIANT 76..77: note = X can be any amino acid
  VARIANT 79..81: note = X can be any amino acid
  VARIANT 83..98: note = X can be any amino acid
  VARIANT 100..102: note = X can be any amino acid
  VARIANT 104..111: note = X can be any amino acid
  VARIANT 118: note = X can be any amino acid
  VARIANT 121..122: note = X can be any amino acid
  VARIANT 125..130: note = X can be any amino acid
  VARIANT 132..133: note = X can be any amino acid
  VARIANT 135..137: note = X can be any amino acid
  VARIANT 139..144: note = X can be any amino acid
  VARIANT 152: note = X can be any amino acid
  VARIANT 154: note = X can be any amino acid
  VARIANT 156..188: note = X can be any amino acid
  VARIANT 190..191: note = X can be any amino acid
  VARIANT 193..194: note = X can be any amino acid
  VARIANT 196..206: note = X can be any amino acid
  VARIANT 210..212: note = X can be any amino acid
  VARIANT 214..216: note = X can be any amino acid
  VARIANT 218..219: note = X can be any amino acid
  VARIANT 221..236: note = X can be any amino acid
YXXFXIXKXXGXXRXIXXPXXXLKXXQXXXXXXLXXXXXXXXXXXGFXXXXSXXXNAXXHXXXXXXXNXDLXXFFXXIXXXRXXXXXXXXXXXXXXXXAXXXAXXXXXXXXLPQGAPXSPXXSNXXXXXXDXXLXXXAXXXXXXYTRYADDXTXSXXXXXXXXXXXXXXXXXXXXXXXXXXXXXXXXXFXXNXXKXXXXXXXXXXXVTGXXXNXXXNXXRXXXXXXXXXXXXXXXX

SEQ ID NO: 19137 - protein, 243 aa, synthetic construct
  VARIANT 2..3: note = X can be any amino acid
  VARIANT 5..7: note = X can be any amino acid
  VARIANT 9..10: note = X can be any amino acid
  VARIANT 13: note = X can be any amino acid
  VARIANT 15: note = X can be any amino acid
  VARIANT 17: note = X can be any amino acid
  VARIANT 20..22: note = X can be any amino acid
  VARIANT 24..26: note = X can be any amino acid
  VARIANT 28..43: note = X can be any amino acid
  VARIANT 48..51: note = X can be any amino acid
  VARIANT 53..55: note = X can be any amino acid
  VARIANT 58..59: note = X can be any amino acid
  VARIANT 61..69: note = X can be any amino acid
  VARIANT 71..73: note = X can be any amino acid
  VARIANT 77..81: note = X can be any amino acid
  VARIANT 84: note = X can be any amino acid
  VARIANT 86: note = X can be any amino acid
  VARIANT 88..90: note = X can be any amino acid
  VARIANT 93..96: note = 93..96
  VARIANT 98..100: note = X can be any amino acid
  VARIANT 102..104: note = X can be any amino acid
  VARIANT 106..125: note = X can be any amino acid
  VARIANT 127: note = X can be any amino acid
  VARIANT 133..134: note = X can be any amino acid
  VARIANT 137..139: note = X can be any amino acid
  VARIANT 141..145: note = X can be any amino acid
  VARIANT 148: note = X can be any amino acid
  VARIANT 151..153: note = X can be any amino acid
  VARIANT 155..160: note = X can be any amino acid
  VARIANT 168: note = X can be any amino acid
  VARIANT 172..193: note = X can be any amino acid
  VARIANT 197..201: note = X can be any amino acid
  VARIANT 203..211: note = X can be any amino acid
  VARIANT 213: note = X can be any amino acid
  VARIANT 217..218: note = X can be any amino acid
  VARIANT 221..226: note = X can be any amino acid
  VARIANT 228..233: note = X can be any amino acid
  VARIANT 236..243: note = X can be any amino acid
YXXFXXXKXXGGXRXIXAPXXXLXXXQXXXXXXXXXXXXXXXXAHGFXXXXSXXXNAXXHXXXXXXXXXDXXXFFPXXXXXRVXGXFXXXGYXXXXAXXXAXXXTXXXXXXXXXXXXXXXXXXXXRXLPQGAXXSPXXXNXXXXXLDXRLXXXAXXXXXXYTRYADDXTFSXXXXXXXXXXXXXXXXXXXXXXEGFXXXXXKXXXXXXXXXQXVTGXXVNXXXXXXRXXXXXXRAXXXXXXXX

SEQ ID NO: 19138 - protein, 243 aa, synthetic construct
  VARIANT 2..3: note = X can be any amino acid
  VARIANT 5..6: note = X can be any amino acid
  VARIANT 9..10: note = X can be any amino acid
  VARIANT 13: note = X can be any amino acid
  VARIANT 15: note = X can be any amino acid
  VARIANT 17: note = X can be any amino acid
  VARIANT 20..22: note = X can be any amino acid
  VARIANT 24..26: note = X can be any amino acid
  VARIANT 28..30: note = 28..30
  VARIANT 32..43: note = X can be any amino acid
  VARIANT 48..51: note = X can be any amino acid
  VARIANT 53..55: note = X can be any amino acid
  VARIANT 58..59: note = X can be any amino acid
  VARIANT 61..69: note = X can be any amino acid
  VARIANT 71..73: note = X can be any amino acid
  VARIANT 77..81: note = X can be any amino acid
  VARIANT 84: note = X can be any amino acid
  VARIANT 86: note = X can be any amino acid
  VARIANT 88..90: note = X can be any amino acid
  VARIANT 93..96: note = X can be any amino acid
  VARIANT 98..101: note = 98..101
  VARIANT 103..104: note = X can be any amino acid
  VARIANT 106..125: note = X can be any amino acid
  VARIANT 127: note = X can be any amino acid
  VARIANT 133..134: note = X can be any amino acid
  VARIANT 137..139: note = X can be any amino acid
  VARIANT 141..145: note = X can be any amino acid
  VARIANT 148: note = X can be any amino acid
  VARIANT 151..153: note = X can be any amino acid
  VARIANT 155..157: note = X can be any amino acid
  VARIANT 159..160: note = X can be any amino acid
  VARIANT 172..193: note = X can be any amino acid
  VARIANT 197..201: note = X can be any amino acid
  VARIANT 203..206: note = X can be any amino acid
  VARIANT 208..211: note = X can be any amino acid
  VARIANT 213: note = X can be any amino acid
  VARIANT 217: note = X can be any amino acid
  VARIANT 221..226: note = X can be any amino acid
  VARIANT 228..233: note = X can be any amino acid
  VARIANT 236..243: note = X can be any amino acid
YXXFXXPKXXGGXRXIXAPXXXLXXXQXXXLXXXXXXXXXXXXAHGFXXXXSXXXNAXXHXXXXXXXXXDXXXFFPXXXXXRVXGXFXXXGYXXXXAXXXXLXXTXXXXXXXXXXXXXXXXXXXXRXLPQGAXXSPXXXNXXXXXLDXRLXXXAXXXGXXYTRYADDLTFSXXXXXXXXXXXXXXXXXXXXXXEGFXXXXXKXXXXRXXXXQXVTGXVVNXXXXXXRXXXXXXRAXXXXXXXX

SEQ ID NO: 19139 - protein, 236 aa, synthetic construct
  VARIANT 2..3: note = X can be any amino acid
  VARIANT 5: note = X can be any amino acid
  VARIANT 7: note = X can be any amino acid
  VARIANT 10: note = X can be any amino acid
  VARIANT 12..13: note = X can be any amino acid
  VARIANT 15: note = X can be any amino acid
  VARIANT 17..18: note = X can be any amino acid
  VARIANT 20..22: note = X can be any amino acid
  VARIANT 24..45: note = X can be any amino acid
  VARIANT 48..51: note = X can be any amino acid
  VARIANT 53..55: note = X can be any amino acid
  VARIANT 58..59: note = X can be any amino acid
  VARIANT 61..65: note = X can be any amino acid
  VARIANT 67: note = X can be any amino acid
  VARIANT 69: note = X can be any amino acid
  VARIANT 72: note = X can be any amino acid
  VARIANT 76: note = X can be any amino acid
  VARIANT 78..81: note = X can be any amino acid
  VARIANT 83..90: note = X can be any amino acid
  VARIANT 92..99: note = X can be any amino acid
  VARIANT 101..105: note = X can be any amino acid
  VARIANT 108..120: note = X can be any amino acid
  VARIANT 125: note = X can be any amino acid
  VARIANT 127: note = X can be any amino acid
  VARIANT 130..132: note = X can be any amino acid
  VARIANT 134..135: note = X can be any amino acid
  VARIANT 137..138: note = X can be any amino acid
  VARIANT 141..142: note = X can be any amino acid
  VARIANT 144..146: note = X can be any amino acid
  VARIANT 148..153: note = X can be any amino acid
  VARIANT 155: note = X can be any amino acid
  VARIANT 161: note = X can be any amino acid
  VARIANT 165..175: note = X can be any amino acid
  VARIANT 177..182: note = X can be any amino acid
  VARIANT 184..191: note = X can be any amino acid
  VARIANT 193..194: note = X can be any amino acid
  VARIANT 198..203: note = X can be any amino acid
  VARIANT 210..211: note = X can be any amino acid
  VARIANT 213..216: note = X can be any amino acid
  VARIANT 219..221: note = X can be any amino acid
  VARIANT 223..226: note = X can be any amino acid
  VARIANT 228..229: note = X can be any amino acid
  VARIANT 231..232: note = X can be any amino acid
  VARIANT 234..236: note = X can be any amino acid
YXXFXIXKKXGXXRXIXXPXXXLXXXXXXXXXXXXXXXXXXXXXXGFXXXXSXXXNAXXHXXXXXVXNXDLXDFFXSXXXXRXXXXXXXXPXXXXXXXXAXXXXXLCXXXXXXXXXXXXXLPQGXPXSPXXXNXXCXXLDXXLXXXAXXXXXXYXRYADDXTFSXXXXXXXXXXXFXXXXXXIXXXXXXXXNXXKTRXXXXXXRQEVTGXXVXXXXNVXXXYXXXXRXXLXXWXXX

SEQ ID NO: 19140 - protein, 238 aa, synthetic construct
  VARIANT 2..3: note = X can be any amino acid
  VARIANT 5..7: note = X can be any amino acid
  VARIANT 13: note = X can be any amino acid
  VARIANT 15: note = X can be any amino acid
  VARIANT 17..18: note = X can be any amino acid
  VARIANT 20: note = X can be any amino acid
  VARIANT 24: note = X can be any amino acid
  VARIANT 26: note = X can be any amino acid
  VARIANT 28: note = X can be any amino acid
  VARIANT 33: note = X can be any amino acid
  VARIANT 36..37: note = X can be any amino acid
  VARIANT 39: note = X can be any amino acid
  VARIANT 41..43: note = X can be any amino acid
  VARIANT 47..51: note = X can be any amino acid
  VARIANT 54: note = X can be any amino acid
  VARIANT 58..59: note = X can be any amino acid
  VARIANT 61..62: note = X can be any amino acid
  VARIANT 64: note = X can be any amino acid
  VARIANT 66: note = X can be any amino acid
  VARIANT 69: note = X can be any amino acid
  VARIANT 72: note = X can be any amino acid
  VARIANT 76: note = X can be any amino acid
  VARIANT 80: note = X can be any amino acid
  VARIANT 86: note = X can be any amino acid
  VARIANT 90: note = X can be any amino acid
  VARIANT 93: note = X can be any amino acid
  VARIANT 95..97: note = X can be any amino acid
  VARIANT 101..102: note = X can be any amino acid
  VARIANT 104: note = X can be any amino acid
  VARIANT 108..109: note = X can be any amino acid
  VARIANT 118: note = X can be any amino acid
  VARIANT 122: note = X can be any amino acid
  VARIANT 128..130: note = X can be any amino acid
  VARIANT 132: note = X can be any amino acid
  VARIANT 136: note = X can be any amino acid
  VARIANT 139..144: note = X can be any amino acid
  VARIANT 154: note = X can be any amino acid
  VARIANT 156..160: note = X can be any amino acid
  VARIANT 163..164: note = X can be any amino acid
  VARIANT 166..177: note = X can be any amino acid
  VARIANT 180: note = X can be any amino acid
  VARIANT 183..184: note = X can be any amino acid
  VARIANT 187..188: note = X can be any amino acid
  VARIANT 192: note = X can be any amino acid
  VARIANT 195..196: note = X can be any amino acid
  VARIANT 198: note = X can be any amino acid
  VARIANT 201: note = X can be any amino acid
  VARIANT 203..204: note = X can be any amino acid
  VARIANT 206: note = X can be any amino acid
  VARIANT 208: note = X can be any amino acid
  VARIANT 213: note = X can be any amino acid
  VARIANT 216..217: note = X can be any amino acid
  VARIANT 221: note = X can be any amino acid
  VARIANT 228..231: note = X can be any amino acid
  VARIANT 238: note = X can be any amino acid
YXXFXXXKKSGGXRXIXXPXKSLXIXQXKLSQXLYXXYXPXXXVHGXXXXXSIXTNAXXHXXKXFXLNXDIXDFFXSINXGRVRGXFIAXPYXLXXXVATXXAXICCXXNKLPQGAPXSPIXSNLICXXXDXELQXFAXXXXXXYTRYADDITXSXXXXXLPXXLXXXXXXXXXXXXLGXELXXIIXXNGFXINXXKXRLXYXXQXQXVTGLXVNXXVNVXRKYIRNXXXXLHAWEKX

SEQ ID NO: 19141 - protein, 222 aa, synthetic construct
  VARIANT 2..3: note = X can be any amino acid
  VARIANT 5..7: note = X can be any amino acid
  VARIANT 9..10: note = X can be any amino acid
  VARIANT 12..13: note = X can be any amino acid
  VARIANT 15: note = X can be any amino acid
  VARIANT 17: note = X can be any amino acid
  VARIANT 20..22: note = X can be any amino acid
  VARIANT 25..26: note = X can be any amino acid
  VARIANT 28..29: note = X can be any amino acid
  VARIANT 32..34: note = X can be any amino acid
  VARIANT 36..37: note = X can be any amino acid
  VARIANT 39: note = X can be any amino acid
  VARIANT 41..43: note = X can be any amino acid
  VARIANT 45: note = X can be any amino acid
  VARIANT 49..50: note = X can be any amino acid
  VARIANT 54: note = X can be any amino acid
  VARIANT 58..59: note = X can be any amino acid
  VARIANT 61..67: note = X can be any amino acid
  VARIANT 69: note = X can be any amino acid
  VARIANT 71: note = X can be any amino acid
  VARIANT 73: note = X can be any amino acid
  VARIANT 78..81: note = X can be any amino acid
  VARIANT 84: note = X can be any amino acid
  VARIANT 86..89: note = X can be any amino acid
  VARIANT 94..99: note = X can be any amino acid
  VARIANT 102: note = X can be any amino acid
  VARIANT 104: note = X can be any amino acid
  VARIANT 106..109: note = X can be any amino acid
  VARIANT 112: note = X can be any amino acid
  VARIANT 119..121: note = X can be any amino acid
  VARIANT 123..126: note = X can be any amino acid
  VARIANT 128: note = X can be any amino acid
  VARIANT 130: note = X can be any amino acid
  VARIANT 132..134: note = X can be any amino acid
  VARIANT 136..137: note = X can be any amino acid
  VARIANT 139..140: note = X can be any amino acid
  VARIANT 142: note = X can be any amino acid
  VARIANT 150..152: note = X can be any amino acid
  VARIANT 155..162: note = X can be any amino acid
  VARIANT 167..168: note = X can be any amino acid
  VARIANT 170..172: note = X can be any amino acid
  VARIANT 176..177: note = X can be any amino acid
  VARIANT 180: note = X can be any amino acid
  VARIANT 182..183: note = X can be any amino acid
  VARIANT 185: note = X can be any amino acid
  VARIANT 187: note = X can be any amino acid
  VARIANT 189: note = X can be any amino acid
  VARIANT 192..193: note = X can be any amino acid
  VARIANT 196: note = X can be any amino acid
  VARIANT 200: note = X can be any amino acid
  VARIANT 202: note = X can be any amino acid
  VARIANT 204..207: note = X can be any amino acid
  VARIANT 209..211: note = X can be any amino acid
  VARIANT 216..217: note = X can be any amino acid
  VARIANT 220..222: note = X can be any amino acid
YXXFXXXKXXGXXRXIXAPXXXLKXXQXXILXXXLXXVXLXXXAXGFRXXRSIXTNAXXHXXXXXXXKXDXKXFFPSXXXXRVXGXXXXLGYPXXXXXXLTXLXTXXXXLPXGAPTSPXXXNXXXXRXDXRXXXLXXKXXFXYSRYADDXXXSSXXXXXXXXIPFFXXIXXXEGFXXNEXKXXIXRXGXRQXXTGXVVNXKXNXXXXEXXXLRAVXXNCXXX

SEQ ID NO: 19142 - protein, 221 aa, synthetic construct
  VARIANT 3: note = X can be any amino acid
  VARIANT 5..7: note = X can be any amino acid
  VARIANT 9: note = X can be any amino acid
  VARIANT 12..13: note = X can be any amino acid
  VARIANT 15..18: note = X can be any amino acid
  VARIANT 20..22: note = X can be any amino acid
  VARIANT 25..26: note = X can be any amino acid
  VARIANT 28..34: note = X can be any amino acid
  VARIANT 36..40: note = X can be any amino acid
  VARIANT 43: note = X can be any amino acid
  VARIANT 45..46: note = X can be any amino acid
  VARIANT 48..51: note = X can be any amino acid
  VARIANT 53..56: note = X can be any amino acid
  VARIANT 58..59: note = X can be any amino acid
  VARIANT 62..67: note = X can be any amino acid
  VARIANT 69: note = X can be any amino acid
  VARIANT 71..72: note = X can be any amino acid
  VARIANT 76..77: note = X can be any amino acid
  VARIANT 79..81: note = X can be any amino acid
  VARIANT 84..99: note = X can be any amino acid
  VARIANT 101..102: note = X can be any amino acid
  VARIANT 104..109: note = X can be any amino acid
  VARIANT 119: note = X can be any amino acid
  VARIANT 123: note = X can be any amino acid
  VARIANT 126..128: note = X can be any amino acid
  VARIANT 130..142: note = X can be any amino acid
  VARIANT 147: note = X can be any amino acid
  VARIANT 150..151: note = X can be any amino acid
  VARIANT 155..159: note = X can be any amino acid
  VARIANT 161..162: note = X can be any amino acid
  VARIANT 164..170: note = X can be any amino acid
  VARIANT 172..174: note = X can be any amino acid
  VARIANT 177..179: note = X can be any amino acid
  VARIANT 181: note = X can be any amino acid
  VARIANT 183..192: note = X can be any amino acid
  VARIANT 194..195: note = X can be any amino acid
  VARIANT 198..199: note = X can be any amino acid
  VARIANT 201..203: note = X can be any amino acid
  VARIANT 205..208: note = X can be any amino acid
  VARIANT 210..221: note = X can be any amino acid
YRXFXXXKXDGXXRXXXXPXXXLKXXQXXXXXXXLXXXXXHPXAXXFXXXXSXXXXAXXHAXXXXXXTXDXXDFFXXTXXXRVXXXXXXXXXXXXXXXXLXXLXXXXXXLPQGAPTSPXLSNXVNXXXDXXXXXXXXXXXXXYTRYXDDXXFSWXXXXXPXXFXXXXXXXLXXXGYXXXPXKXXXXXXXXXXPXXTGXXLXXXGXXXXPXXXXXXXXXXXX

SEQ ID NO: 19143 - protein, 5 aa, synthetic construct
GGGGS

SEQ ID NO: 19144 - DNA, 10 bp, synthetic construct
  source 1..10: mol_type = other DNA
ttacgtctgc

SEQ ID NO: 19145 - DNA, 11 bp, synthetic construct
  source 1..11: mol_type = other DNA
gtcaatggacc

SEQ ID NO: 19146 - DNA, 11 bp, synthetic construct
  source 1..11: mol_type = other DNA
ggtccattgac

SEQ ID NO: 19147 - protein, 7 aa, synthetic construct
PKKKRKV

SEQ ID NO: 19148 - protein, 8 aa, synthetic construct
VSRKRPRP

SEQ ID NO: 19149 - protein, 6 aa, synthetic construct
QRKRKQ

SEQ ID NO: 19150 - protein, 288 aa, synthetic construct
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 19151 - protein, 183 aa, synthetic construct
RPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRAS

SEQ ID NO: 19152 - protein, 4 aa, synthetic construct
  REGION >1: note = The amino acid residue 1 can be repeated four to thirty times
GGGS

SEQ ID NO: 19153 - protein, 9 aa, synthetic construct
GGSGGSGGS

SEQ ID NO: 19154 - protein, 15 aa, synthetic construct
GGGGSGGGGSGGGGS

SEQ ID NO: 19155 - protein, 5 aa, synthetic construct
  REGION >5: note = The entire sequence of amino acids 1-5 can be repeated three to fifteen times
GGGGS

SEQ ID NO: 19156 - protein, 32 aa, synthetic construct
LEPGEKPYKCPECGKSFSQSGALTRHQRTHTR

SEQ ID NO: 19157 - protein, 20 aa, synthetic construct
PKKKRKVEASSPKKRKVEAS

SEQ ID NO: 19158 - DNA, 33 bp, synthetic construct
  source 1..33: mol_type = other DNA
gccaacatgaggatcacccatgtctgcagggcc

SEQ ID NO: 19159 - RNA, 20 nt, synthetic construct
  source 1..20: mol_type = other RNA
  ncRNA 1..20: ncRNA_class = guide_RNA
gagtccgagcagaagaagaa

SEQ ID NO: 19160 - RNA, 277 nt, synthetic construct
  source 1..277: mol_type = other RNA
tgataagattccgtatgcgcacccttagcgagaggtttatcattaaggtcaacctctggatgttgtttcggcatcctgcattgaatctgagttactgtctgttttcctacaaacggcagaagctggaggaggaagggcctgagtccgagcagaagaaaaagttctcccatcacatcaaccggtggcgcattgccacgaagcaggccaatggggaggacatcgatgtcaaggaaacccgtttcttctgacgtaagggtgcgcatacggaatcttatca

SEQ ID NO: 19161 - RNA, 268 nt, synthetic construct
  source 1..268: mol_type = other RNA
ccgtagtgggagcctcaggcgagggtgtgtatcatgcccgttctgccaagacccaccaaagaagggcaccgtggaggacaaacggcagaagctggaggaggaagggcctgagtccgagcagaagaaacagaagtgcaaagttctcccatcacatcaaccggtggcgcattgccacgaagcaggccaatggggaggacatcgatgtcacctccacggtgcaatgcgaaagcaacttgaggctttgcttagtatgaggctcccactacgg

SEQ ID NO: 19162 - protein, 340 aa, synthetic construct; identical to SEQ ID NO: 2042

SEQ ID NO: 19163 - RNA, 255 nt, synthetic construct
  source 1..255: mol_type = other RNA
gttaaggtggttatattctagtatttatgaagtgtagtcgcttcgatcgttaaggctgattttaacctctgcataataatatcggtagatattattatgcacgctccctttagcagagctaagaatcgctcactcaggcacaagctttgaggacaaacggcagaagctggaggaggaagggcctgagtccgagcagaagaatcctaagagaaaagttctcccatcacatcaaccggtggcgcattgccacgaagc

SEQ ID NO: 19164 - protein, 671 aa, synthetic construct; identical to SEQ ID NO: 6083

SEQ ID NO: 19165 - RNA, 338 nt, synthetic construct
  source 1..338: mol_type = other RNA
gctccggagcaatgagcaggctcttgcaatccgggcggtgtttcgccgcccttgtgaactgccgtttcatgcaccacgggcgccgttttcactgtgccaccccagccacggtagtgctacaaacggcagaagctggaggaggaagggcctgagtccgagcagaagaactacaaggttaaagttctcccatcacatcaaccggtggcgcattgccacgaagcaggccaatggggaggacatcgatgtcaagcactaccgtggcggggtggcgtcgagcgaacagctcccgtcccgtgagccctacaggctcttcgacgagatgcacattgctccggagc

SEQ ID NO: 19166 - protein, 499 aa, synthetic construct; identical to SEQ ID NO: 6943

SEQ ID NO: 19167 - RNA, 319 nt, synthetic construct
  source 1..319: mol_type = other RNA
gcggagtgctggcctcaactgatacagagaatatgggcggtgattcgccgtctttacagttaaggcacaatttaaaagaggttccgcacccaagcctgtcttgggctgcacaaacggcagaagctggaggaggaagggcctgagtccgagcagaagaacgtatggcctaaagttctcccatcacatcaaccggtggcgcattgccacgaagcaggccaatggggaggacatcgatgtcagcagcccaagacaggcttgggtgcggatctacgagcaattaaatattggttcgatgtccagtgatgaggccagcacccgc

SEQ ID NO: 19168 - RNA, 987 nt, synthetic construct
  source 1..987: mol_type = other RNA
  modified_base order(2,7,9,16,18,20,24,28,29,35,36,42,43,44,50,56,59,66,68,75,77,90,95,97,101,110,116,119,122,124,126,136,137,138,142,149,151,158,174,185,194,195,196,198,204,215,223,224,232,236,237,239,240,248,251,252,260,262,265,268,274..276,279,281,282,286..288,305,308,309,329,333,339,340,341,344,346,347,353,358,359,366..369,370..372,380,390,395,397,398,402,404..408,414,416,417,421,426,431,432,434,435,438,439,443,444,446,447,455,456,457,459,460,462,463,471,473,475,476,498,505,506,513..515,518..520,522,523,530,534,535,537,542,550,569,572,574,576,583,594,596,597,602,604,606,613,617,626,629,642,643,644,646,647,649,650..652,654,656,659,664,673,674,677,680,681,684,685,696,697,699,701,703,715,717,728,737,740,743,744,745,747,758,762,764,778,780,788,800,809,811,812,814,816,833,842,850,853,854,856,859,860,863,866,872,877,895,896,899,904,906,908..910,917,928,930,944,954,983,985): mod_base = m1f
atgaaatctgcagagtatctgaatacgttccgccttaggaatttgggcctccccgtgatgaacaatctccacgatatgagcaaggcgactcgaatatccgtggaaacgctgagactgctcatctatacagcagactttcggtacaggatctacacggtcgaaaagaaggggcctgagaaacgcatgcgaacaatttatcaacctagccgagagctcaaggcgttgcagggctgggttcttcgaaacatccttgacaaactctcatcatcaccctttagtattgggtttgaaaagcaccaaagcatccttaacaacgcgacgccacacataggtgccaatttcatattgaacatcgacttggaggatttttttccgagcctcacagccaataaagtgttcggtgtttttcacagtcttgggtacaatcgccttattagttccgttcttaccaagatttgttgttacaagaatctcttgccccagggagcacccagcagtccgaaattggcgaatttgatttgttccaagctcgattatcgaatacaagggtacgcgggcagccggggactcatctatacccgctacgcagacgatcttacgctgtctgcccaatcaatgaagaaggtcgtaaaggcgcgggatttcttgttttctatcatcccgtccgagggcttggtaattaattccaaaaagacttgtatctcaggaccacgatctcagcgaaaagtgacaggactcgtcatttctcaagaaaaagtcggtatagggagagagaagtataaggaaatccgcgcgaagatccaccacatattctgtggcaagagcagcgagatagaacacgtccgaggctggttgtccttcatactgagcgtggactcaaaaagccaccgccggttgatcacctatatttcaaaactggaaaagaaatatggaaagaacccactcaacaaagctaaaacaccaccaaagaagaaaagaaaggtctga

SEQ ID NO: 19169 - RNA, 399 nt, synthetic construct
  source 1..399: mol_type = other RNA
gaaatgataagattccgtatgcgcacccttagcgagaggtttatcattaaggtcaacctctggatgttgtttcggcatcctgcattgaatctgagttactgtctgttttcctacaaacggcagaagctggaggaggaagggcctgagtccgagcagaagaaaaagttctcccatcacatcaaccggtggcgcattgccacgaagcaggccaatggggaggacatcgatgtcaaggaaacccgtttcttctgacgtaagggtgcgcatacggaatcttatcagagtccgagcagaagaagaagtttcagagctatgctggaaacagcatagcaagttgaaataaggctagtccgttatcaacttgaaaaagtggcaccgagtcggtgctttttttttttt

SEQ ID NO: 19170 - RNA, 975 nt, synthetic construct
  source 1..975: mol_type = other RNA
  modified_base order(2,8..10,13,15,17,20,34,35,38,49,50,55,62,65,84,91,98,99,119,123,128,130,135,139,141,142,144,149,155,158,163,166,170,173,182,184,185,187,193,194,200,214,219,220,221,224,231,235,237,239,244,246,254,257,270,280,283,287,288,293,294,299,307,308,310..312,320,325,326,334,335,340,342,346,347,348,355,360,368,373,374,385,398,401,402,407,410,411,419,420,421,423..425,428..430,432,436,438,443,449,454,455,462,463,468,470,471,473,480..482,485,497,509,513,521,528,530,539,546,550,555,559,572,575,578,590,601,603,608,611,613,614,619,622,623,635,644,654..656,662,666,668,676,677,683,685,688,690,696,703,707,708,710,713,722,723,728,730,732,735,739,740,746,750,752,760,762,764,776,782,788,790,792,794,797,799,807,809,810,812,836,838,844,848,853,858,866,870,877,878,880,890,894,901,904,905,914,919,923,932,936,939,944,971,973): mod_base = m1f
atgcgcatttactctctgatcgacagccaaaccttaatgaccaaagggttcgcatccgaggtcatgaggagcccagaaccccctaagaagtgggacattgcgaagaagaagggcggaatgcgtacgatataccatccctcttctaaggtgaagctgatacagtactggctgatgaacaacgtgttctccaaattgccgatgcacaacgccgcgtacgctttcgtgaagaatagatctatcaagtctaacgcactgctgcacgcagagagtaagaacaaatactacgttaagattgacctgaaggacttctttccaagcatcaagttcacagacttcgaatatgcctttacccggtaccgtgacagaatagagttcacgaccgagtacgacaaagaactgcttcagctgattaagaccatttgtttcatttctgactctacactgccaataggcttccccacttcccctcttatagccaatttcgtcgccagggagctggacgagaagctcactcagaagctgaacgctatagacaagctcaacgctacgtacactcgctacgcagacgacataatcgtgagcacgaacatgaagggcgcctctaagctgatcttagactgcttcaagcggaccatgaaggaaatcggacccgatttcaagatcaatatcaagaagttcaaaatatgctctgccagtggcggctcaattgtcgtgacgggccttaaggtctgtcatgacttccacataactctgcaccggtctatgaaggacaagatccgcctgcacctctctctcctgtccaaaggtattctgaaggacgaggaccacaacaagctgtccgggtacatcgcctacgctaaggacatcgatccacacttctacaccaagctcaataggaagtacttccaggagatcaagtggatacaaaacctgcataataaggtggagccaccaaagaagaaaagaaaggtctga

SEQ ID NO: 19171 - RNA, 418 nt, synthetic construct
  source 1..418: mol_type = other RNA
gaaatgataagattccgtaagagccaaacctagcattttatgggttaatagcccatcgggccatgagtcatggtttcgcctagtattttagctatgcccgtcgttcagttcgctgaacaaacggcagaagctggaggaggaagggcctgagtccgagcagaagaattacgtctgcaaagttctcccatcacatcaaccggtggcgcattgccacgaagcaggccaatggggaggacatcgatgtcatcagcgaactgatcgacgtgctcaagtaggtttggctcttacggaatcttatcagagtccgagcagaagaagaagtttcagagctatgctggaaacagcatagcaagttgaaataaggctagtccgttatcaacttgaaaaagtggcaccgagtcggtgctttttttttttt

SEQ ID NO: 19172 - RNA, 984 nt, synthetic construct
  source 1..984: mol_type = other RNA
  modified_base order(2,9,21,23,26,27,31,32,36,38,40,41,46,48,54,55,58,66,74,75,83,84,87,92,96,99,102,105,114,115,125,126,128,130,131,135,156,158,159,161,164,165,171,174,175,178,179,181,182,191,192,203..206,215..218,222,226..228,233,235,241..243,246,253,265,272,275,277,279,295,311,313,314,320,324,326,334,335,337,338,342,343,345,347,348,351,352,355,356,362,364,371,373,374,375,388,389,399,401,404,410,413,417,418,422,424,426,427,429,430,432,443,444,453,459,463,468,473,474,475,480,482,485,488,496..498,501,509,510,517,520,522,528,536,537,541,546,550,553,558,563,568..570,573,580,581,585,596,603,608,610,615,617,619,620,624,629,635..637,641,645,658,662,665,672,673,675,689,698,699,701,702,704,708,722,723,741,746,750,758,764,766,775,777,782,783,785,787,789,792,794,796,801,807,812,816,819,828,830,837,850,852,854,856,858,863,875,876,880,884,885,887,888,893,894,900,906,913..915,931,935,936,944,946,947,950,951,955,980,982): mod_base = m1f
atggacgctaccagaacgactctccttgcattggatctcttcggatctccaggttggtccgccgataaagaaattcagaggcttcatgcgctcagtaatcatgctggaaggcattacagaaggattatattaagtaaaaggcacggcggacagcgtcttgtgcttgcacctgattacttgttaaagaccgttcagcgcaacattttgaagaacgttttgagtcaatttccactgtcaccatttgctacagcctacagaccgggatgcccaatcgtgtctaacgcgcagccacactgccaacagccacagatcttgaaactcgatatagaaaacttcttcgattctattagttggttgcaggtgtggcgggtgtttcgccaggcccagttgccccgaaatgtcgtaacgatgctcacttggatatgttgttataacgacgcacttccgcagggtgcccctacatcccctgcaatttccaatctcgtcatgagaaggtttgatgaacggattggagaatggtgtcaggctcgagggattacctacactcgctactgcgatgacatgacgtttagtggacacttcaatgcaaggcaggtcaagaataaagtctgcggtctcttagctgagctgggcctttccctgaataaacggaaaggctgcctcatagcggcttgtaagcgccagcaagtcaccggcattgttgtgaatcacaagccacagcttgcccgagaagccaggcgtgccctgcgtcaggaagtgcacctgtgccagaaatatggagttatctctcatctctcacatagaggtgaactggatcctagcggagatctgcacgctcaggcgacagcgtatctctatgcactccaggggagaattaactggcttcttcaaattaaccctgaggatgaggcgtttcaacaggcccgggagtccgttaagaggatgttagttgcctggccaccaaagaagaaaagaaaggtctga

SEQ ID NO: 19173 - RNA, 437 nt, synthetic construct
  source 1..437: mol_type = other RNA
gaaatgataagattccgtacgccagcagtggcaatagcgtttccggccttttgtgccgggagggtcggcgagtcgctgacttaacgccagtagtatgtccatatacccaaagtcgcttcattgtaacaaacggcagaagctggaggaggaagggcctgagtccgagcagaagaatccttcgagcaaagttctcccatcacatcaaccggtggcgcattgccacgaagcaggccaatggggaggacatcgatgtcatacagttacgcgccttcgggatggtttaatggtattgccgctgttggcgtacggaatcttatcagagtccgagcagaagaagaagtttcagagctatgctggaaacagcatagcaagttgaaataaggctagtccgttatcaacttgaaaaagtggcaccgagtcggtgctttttttttttt

SEQ ID NO: 19174 - RNA, 111 nt, synthetic construct
  source 1..111: mol_type = other RNA
gagtccgagcagaagaagaagtttcagagctatgctggaaacagcatagcaagttgaaataaggctagtccgttatcaacttgaaaaagtggcaccgagtcggtgcttttt

SEQ ID NO: 19175 - RNA, 111 nt, synthetic construct; identical to SEQ ID NO: 19174
  source 1..111: mol_type = other RNA

SEQ ID NO: 19176 - protein, 34 aa, synthetic construct
  VARIANT 12..13: note = X can be any amino acid
LTPAQVVAIASXXGGKQALETVQRLLPVLCQDHG

SEQ ID NO: 19177 - protein, 34 aa, synthetic construct; identical to SEQ ID NO: 19176
  VARIANT 12: note = X can be any amino acid
  VARIANT 13: note = X can be any amino acid or absent

SEQ ID NO: 19178 - protein, 34 aa, synthetic construct
  VARIANT 12..13: note = X can be any amino acid
LTPDQVVAIANXXGGKQALATVQRLLPVLCQDHG

SEQ ID NO: 19179 - protein, 34 aa, synthetic construct
  VARIANT 12..13: note = X can be any amino acid
LTPDQVVAIANXXGGKQALETLQRLLPVLCQDHG

SEQ ID NO: 19180 - protein, 34 aa, synthetic construct
  VARIANT 12..13: note = X can be any amino acid
LTPDQVVAIANXXGGKQALETVQRLLPVLCQDHG

SEQ ID NO: 19181 - protein, 34 aa, synthetic construct
  VARIANT 12..13: note = X can be any amino acid
LTPDQVVAIASXXGGKQALATVQRLLPVLCQDHG

SEQ ID NO: 19182 - protein, 34 aa, synthetic construct
  VARIANT 12..13: note = X can be any amino acid
LTPDQVVAIASXXGGKQALETVQRLLPVLCQDHG

SEQ ID NO: 19183 - protein, 34 aa, synthetic construct
  VARIANT 12..13: note = X can be any amino acid
LTPDQVVAIASXXGGKQALETVQRVLPVLCQDHG

SEQ ID NO: 19184 - protein, 34 aa, synthetic construct
  VARIANT 12..13: note = X can be any amino acid
LTPEQVVAIASXXGGKQALETVQRLLPVLCQAHG

SEQ ID NO: 19185 - protein, 34 aa, synthetic construct
  VARIANT 12..13: note = X can be any amino acid
LTPYQVVAIASXXGSKQALETVQRLLPVLCQDHG

SEQ ID NO: 19186 - protein, 34 aa, synthetic construct
  VARIANT 12..13: note = X can be any amino acid
LTREQVVAIASXXGGKQALETVQRLLPVLCQDHG

SEQ ID NO: 19187 - protein, 35 aa, synthetic construct
  VARIANT 12..13: note = X can be any amino acid
LSTAQVVAIASXXGGKQALEGIGEQLLKLRTAPYG

SEQ ID NO: 19188 - protein, 35 aa, synthetic construct
  VARIANT 12..13: note = X can be any amino acid
LSTAQVVAVASXXGGKPALEAVRAQLLALRAAPYG

SEQ ID NO: 19189 - protein, 11 aa, unidentified
  source 1..11: note = Human immunodeficiency virus
YGRKKRRQRRR

SEQ ID NO: 19190 - protein, 16 aa, Xenopus sp.
  VARIANT 3..12: note = X can be any amino acid
KRXXXXXXXXXXKKKL

SEQ ID NO: 19191 - RNA, 165 nt, synthetic construct
  source 1..165: mol_type = other RNA
nyyyttnngcnnnnrrrnnnnnnnnnnnnnnyyyngtcnggygnttngccagacnnnrnnnnattgnnnrnnnttrnnnnyrcgnnrnnnnnnnnnnnnnnnnnnnnnnnnnnnnnnnnnnnnnnnnnnnnnnnnnnnnnnynncgynnnytynagnnaarrrnn

SEQ ID NO: 19192 - RNA, 150 nt, synthetic construct
  source 1..150: mol_type = other RNA
tannntnnnnnyatryyrrygactggagyatctccagtcrnnnnnnyyggycyctannrgynnynanyynnnnttrynnnyrynynnnnnnnnnnnnnnnnnnnnnnnnnnnrnryrnnnrtarnnnnnnnnnnnnnnnnnnnnnnnynn

SEQ ID NO: 19193 - RNA, 186 nt, synthetic construct
  source 1..186: mol_type = other RNA
nntrrtatnrtnrrnnanryttcnnyynygatagnnnnnrgggrnynnnnnnnnnnrnynnrnnnnnnnnynnnnyyagyyynnnnnnnnnnnnnynnnnnnnnnnnnnnnnnnnnrnnyntynrrnnynacrnnngtgnaanrntgtnnttngtatcrnrrnngaarynnnnnnatgaanaannn

SEQ ID NO: 19194 - RNA, 131 nt, synthetic construct
  source 1..131: mol_type = other RNA
nrrcntryrgnyagatttnnnnnyyrygyntcgyrrnnnntganrnnaaygnynrrnnnnntnnnnnnnnnnynnnnnnnnnnnnnnnnnnnnnnnnnnnnnnnnnnnygcryargagtrncyryangyyn

SEQ ID NO: 19195 - RNA, 159 nt, synthetic construct
  source 1..159: mol_type = other RNA
nnrnyyyttagynnnnnrannnnnnnnnnnnnnnnntynngycnggygtnnagccagrcynnnnynnattgnnrrnnttnnnngyrnnnnnnnnnnnnnnnnnnnnnnnnnnnnnnnnnnnnnnnnnnnnnnnnnnnnyncnynnnngtarrrrnynnn

SEQ ID NO: 19196 - RNA, 165 nt, synthetic construct
  source 1..165: mol_type = other RNA
nnnnnnnnnnnrnnnnngrnnnrngnnncnynnnyynnnnnnnnnrrnnnnnnnnnnnnnnnnnnnnngyggccarnrrnnncnnnnnynnnnnnnnnnnnnnnnnnnnnngnnnyynytggccrcnnnyynnnnnnnnnnnnnnnnnnnnnnnnnnnnnnnnnn

SEQ ID NO: 19197 - RNA, 151 nt, synthetic construct
  source 1..151: mol_type = other RNA
yyyttagnnnnnnnnnnnnnnnnnnnnnnnnnnyggrnrrtgnttcgyynyccnnnrnnnaannynnnnnnnnrnynnnynnrrnnnnnnnnnnnnnnnnnynnnnrnnnnnnnnnnnnnnnnnyynnnnnnrnnnnntnnrnngtaarrr

SEQ ID NO: 19198 - RNA, 229 nt, synthetic construct
  source 1..229: mol_type = other RNA
rrcntnynnngyyrccttagcnnytaaggttrrngyanyyannannnngtnaaattnnnnnnrrctnncryynaynnttynnnnnnnnrnnnnnnnnnynnnnrnnncnnynnrnnnnnrcnrnctnngytynnnynnngarcnynnnnnnnnnnnnnnynnnnnnarnnaanynnynnnnaatttnagtaggrytcytyttnnnnnnnrrrrrnnryrnnnatrnrnn

SEQ ID NO: 19199 - RNA, 205 nt, synthetic construct
  source 1..205: mol_type = other RNA
nrnnrrnngnnnnnnnnnnnnnnnnntnggnygnygnntcrncrnycnnrnnnnnagrynnnnynnnnnrrrnnnyrnnnnnnnnrnnnnnnnnnnnnnnnnnnnnnnnnnnnnnnnnnnnnnnnnnnnnynnnnnnnncrnnynynrrgcaryynnnnnnnnnytggnnnnnnnnnnnnnnnncnnyynnynnnynnnnnnnnn

SEQ ID NO: 19200 - RNA, 140 nt, synthetic construct
  source 1..140: mol_type = other RNA
ynrrnnnnnnnnnnnnnnnnnnnnnnnnnnnngrnyrrygagtcryyrnycnnnnnrngaaynnnntttcragcnnnnnnnnnnnnnnnnnnnnnnnnynrrrnnnnnnnnnnnnnnnnnnnnnnnnnnnnnnnnnnnrn

SEQ ID NO: 19201 - RNA, 203 nt, synthetic construct
  source 1..203: mol_type = other RNA
ngnnnrnnrrnrytagyannnngrrgtgnantcgcyyynnnnrytnaggynnnynttanccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnynnnnnnnnnnrnnnnnnnnnnrnnrgtarynnnnnynnnyy

SEQ ID NO: 19202 - RNA, 225 nt, synthetic construct
  source 1..225: mol_type = other RNA
rntgagrrnnyyrnnnnnnnnryytagynnnnnnnnnnnnnnnnnnnnnnnnnnnnnnnnnnnnnnnnnnnnnnnnngrrnnnnrrrnynnyrnnnyyynnngrnnarcnnnygynnnnnnnnnnnnnnnnnnnrnnnnnnnnnnnnnnnnnnnngynyynnnnnnnnnnnynnnnnnnnnyncnnnnnnngnnyyraagtarrtgnnnnnnyrrnnyyctcanc

SEQ ID NO: 19203 - RNA, 129 nt, synthetic construct
  source 1..129: mol_type = other RNA
rytagcnnynnynnnnnnnnnnnnnnnrrrnnnyynnrnynnntnrnynnrrnnnnnntraagynacyttnyanyrnynnnnryrnaayrynnnnnnnnnnnnnnnnnnyynyrynnnnnnyrcnnnry

SEQ ID NO: 19204 - RNA, 187 nt, synthetic construct
  source 1..187: mol_type = other RNA
nryrnynnytagaanngarnrrcragtygyynytcnnngnnnnaangyynctnnntnnnnnnnrnrnnrrnnnnnnnnnnnnnyynnynynnnnnnnnnnnnnnnnnnnnnnnnnnnnnnnnnnnnnnnnnnnnnnnnnnnnnnnnnnnnnnnnnnnnnnnnrnnnnnrrnnynrgtarnrrntryn

SEQ ID NO: 19205 - RNA, 177 nt, synthetic construct
  source 1..177: mol_type = other RNA
rrnrnynrytagnntnnnrnrgyrantygcynynnnnnnnnrnnangnnnctaanynnynnnnnnnnnnynrnynnnnnnnnnnnnnrnrnynnnnnnnnnnnnnnnnnnnnnnnnnnnnnnnnnnnnnnnnnnnnnnnnnnnnnnnnnnnnnnnnnnnnnnnnngtarynrnynyn

SEQ ID NO: 19206 - RNA, 148 nt, synthetic construct
  source 1..148: mol_type = other RNA
nnynnyyrrnnnngcyynnnnnnnnrrgcgyyynnnnnnnnnnnnnnrrrcnyrynngrrgrnnnnnnnnnnnnynnnncyyynnnnnnnnrnagnagnnnnngryrntrrryyyrgycrnrnrrrrnnrnggcngynnyyrrnnnnn

SEQ ID NO: 19207 - RNA, 168 nt, synthetic construct
  source 1..168: mol_type = other RNA
nnnannnnnnnnnngyggnrrynyynngcgngrgtgtgyatcaygcycryyngcnaagryyrnnnayagaaggryrncngnnnnnnrncnrnygntccttcgrancnyynrnynnnnnncngncnnynnnnrrrarnnnnnnrrctttgctnnrnrrnnyynccrcnn

SEQ ID NO: 19208 - RNA, 190 nt, synthetic construct
  source 1..190: mol_type = other RNA
ynynnnrryyaatnnnnntrttyyynnnnnnnnnnnnnttggtctggcnnnnnnrnnynnnnnnnnnnnrnyrrnrnnrrnnnnnnnaygnnnnrnnynannntnranntnnnnnynrynnnnnnnrnnragarcnynnnnnnnnnnnynnragnnrrnnnnnnnnnnranrrnnrrrttgryynnrrnr

SEQ ID NO: 19209 - RNA, 143 nt, synthetic construct
  source 1..143: mol_type = other RNA
ycrynnnnnnyngrrnnnnnnnnnnyyygyggrrrnnnnnnnnnnyytctrnynyytnynnnnnnnnnnnnnnnnnnnnnnnnnnnnnnnnnnnnnnnnrnnnrnrnnnnrnnyynnnrngrnnnnrrnnynnnnnnnnnrrr

SEQ ID NO: 19210 - RNA, 125 nt, synthetic construct
  source 1..125: mol_type = other RNA
nnnnnyacgrggtctcccytcncanncrcgcyrnnnnnnnnryggcgyrnrnnnnnnygtnnnnrynnnnncnynyrcgccryrnnnnrnnnnnnyrgcgygnntggargggagaccycgtrnnn

SEQ ID NO: 19211 - RNA, 142 nt, synthetic construct
  source 1..142: mol_type = other RNA
nnnnrynnnynnnnnnrnrttranyynnryygynnynanygcrrynnnnnnnnnaangynnnnnnnnnnnnnnncnnnnnnnnnnnnnnnnnnnnnnnnnnnnnnnnnnnnnnrtarngnrarnnyrnnnnrnnnrynyyny

SEQ ID NO: 19212 - RNA, 139 nt, synthetic construct
  source 1..139: mol_type = other RNA
nnrnryyycnnyyynnnnnnnnnnnygnngtygnnnyyrcnncrrnnnnnnnaaygtnnnynynyrnnnnnnnnnnnnnnrnnnnnnnnnnnnnnnnnnnnnnnnnnnnnrnrnaargtrnnygnrgnngrrrynyyny

SEQ ID NO: 19213 - RNA, 221 nt, synthetic construct
  source 1..221: mol_type = other RNA
nnrnnrnnnnnnnnnnnnnyyngcnnnnnnnnnryggygnnncgccrynnnngnnnnnnnnynnnnnnyncnycncnrrnnnnnyynynnynnngnnnnnnnnnnnnnnnnnnnnnnnnnnnnnnnnnnnnnnnnnnnnnnnnnnnnnnnnnnnnnnnnnnnnnnncnnnngtnrrnnnnyynngtcynnrgnnnnnnngnrgnnnnnnnnnnnnnynnyn

SEQ ID NO: 19214 - RNA, 205 nt, synthetic construct
  source 1..205: mol_type = other RNA
ryynrnnnnnanntnttganyynygynyrnygnnnntygnyrnrtnnyyynnnnnnnnnnnrrrntnaaygtynnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyrtanayaaagaanannnnnnynrry

SEQ ID NO: 19215 - RNA, 177 nt, synthetic construct
  source 1..177: mol_type = other RNA
nnnnnrrcrryagynnnnnynnnnnnnnnnnnrnnnngryrgcgagtcgcyryynnnnnnnnnnnnnnnnnnnnnnnnnnnnnnnnnnnnnnnnnnyrctynrnngnannnnnryncaynnyrtgnrynnnnnnntncrnctncrynnynynnnrnnnnnnnyngtryygyynnnnn

SEQ ID NO: 19216 - RNA, 140 nt, synthetic construct
  source 1..140: mol_type = other RNA
nncragnnnnnnnnnnnnnnnnnnnnnnnnnnnnnctnyggggynaccccrnggnnnnnnnnnnnnnynnnnynnnncrnygcrngnnnnnnnnyrcgcnnyrcgyrnnnnnnnncnygcnnnrcnrgnynngtygnnnn

SEQ ID NO: 19217 - RNA, 40 nt, synthetic construct
  source 1..40: mol_type = other RNA
cctgagtccgagcagaagaagaagggctcccatcacatca

SEQ ID NO: 19218 - RNA, 40 nt, synthetic construct
  source 1..40: mol_type = other RNA
cctgagtccgagcagaagaaagaagggctcccatcacatc

SEQ ID NO: 19219 - RNA, 37 nt, synthetic construct
  source 1..37: mol_type = other RNA
cctgagtccgagcagaagaagggctcccatcacatca

SEQ ID NO: 19220 - RNA, 34 nt, synthetic construct
  source 1..34: mol_type = other RNA
cctgagtccgagcagaagggctcccatcacatca

SEQ ID NO: 19221 - RNA, 14 nt, synthetic construct
  source 1..14: mol_type = other RNA
ctcccatcacatca

SEQ ID NO: 19222 - RNA, 39 nt, synthetic construct
  source 1..39: mol_type = other RNA
cctgagtccgagcagaagagaagggctcccatcacatca

SEQ ID NO: 19223 - RNA, 19 nt, synthetic construct
  source 1..19: mol_type = other RNA
cctgagtcccatcacatca

SEQ ID NO: 19224 - RNA, 40 nt, synthetic construct
  source 1..40: mol_type = other RNA
cctgagtccgagcagaagaattacgtctgcaaagttctcc
